United States Patent 11,326,182 (COMPOSITIONS FOR THE TREATMENT OF DISEASE) - sequence listing, part 2

SEQ ID NO: 4321 - protein, 124 aa, Artificial Sequence
  Description of Artificial Sequence: Synthetic polypeptide
EVQLQQSGPELVKPGASVKISCKASGYSFTGYFMHWVKQSHGNILDWIGNIYPYNGVSNYNQRFKAKATLTVDKSSSTAYMELRSLTSEDSAVYYCARRYYYGTGPADWYFDVWGTGTLVTVSS

SEQ ID NO: 4322 - protein, 107 aa, Artificial Sequence
  Description of Artificial Sequence: Synthetic polypeptide
DIKMTQSPSSMYASLRERVTITCKASQDINSYLSWFQQKPGKSPKTLIYRANRLVDGVPSRFSGSGSGQDYSLTISSLEYEDMGIYYCLQCDEFPLTFGAGTKLELK

SEQ ID NO: 4323 - protein, 118 aa, Artificial Sequence
  Description of Artificial Sequence: Synthetic polypeptide
QVNLRESGGGLVRPGGSLRLSCAASGFTVSGYAMSWVRQAPGKGLEWVSAISRFSDTTYSADSVKGRFTISRDNSKNTVYLQMNSLRAEDSAVYYCARDPSGHGMDVWGQGTLVTVSA

SEQ ID NO: 4324 - protein, 121 aa, Artificial Sequence
  Description of Artificial Sequence: Synthetic polypeptide
EVQLVESGAEVKEPGSSVRVSCKTSGGSFNRHVITWVRQAPGQGLEWMGEIIPFFGTPKYAPKFQGRVTIIADASTSTFFLDVKSLTSEDTALYFCWIVVVSVVQRREDFWGQGILVTVSS

SEQ ID NO: 4325 - protein, 125 aa, Artificial Sequence
  Description of Artificial Sequence: Synthetic polypeptide
EVQLVESGGGLVQPGGSLRLSCAVSGFTFDTFAMSWVRQAPGKGLEWVSAITASSSKTYYADSVKGRFTISRDNSRNTVYLRLSSLRADDTAVYFCARPKGAHSGLYIESAFDLWGPGTMVTVSS

SEQ ID NO: 4326 - protein, 127 aa, Artificial Sequence
  Description of Artificial Sequence: Synthetic polypeptide
EVQLVESGGGLVKPGGSLRLSCAASGLPFSKAWMSWVRQAPGKGLEWVGRIKSQADGGAIDYATSVNGRFTITRDDSKNTLYLQMTSLKTEDTAVYYCTPGIILRFLEGTLRGMDVWGQGTTVTVSS

SEQ ID NO: 4327 - protein, 124 aa, Artificial Sequence
  Description of Artificial Sequence: Synthetic polypeptide
EVQLLESGGGLIRPGGSLRLSCAASGFTFSNYAMGWVRQAPGKGLEWVSAISGNGGSTYYGGSVKGRFTISRDKSKNTLYLQMNNLRADDTAVYFCAKLEAVAPTLTLRYFKHWGKGTLVTVSS

SEQ ID NO: 4328 - protein, 122 aa, Artificial Sequence
  Description of Artificial Sequence: Synthetic polypeptide
QVQLQQWGAGRLRPSETLSLTCAVYGGSFNGYARTWIRQPPGKGLEWIGEIDHRENTNYNPSLKSRVTMSVDTSKNQFSLRLNSVTAADTAVYFCARGQKNAKDQHEGFRYWGRGTLVTVSS

SEQ ID NO: 4329 - protein, 121 aa, Artificial Sequence
  Description of Artificial Sequence: Synthetic polypeptide
QVQLVESGGGVVQPGRSLRLSCAASGYIFSSFGMHWVRQTPGKGLEWVALIWYDGSRQSYADSVRGRFTISRDNSKNTVFLQMNSLRGEDTAVYHCARTGYDDKRGGFDTWGQGTMVTVSS

SEQ ID NO: 4330 - protein, 130 aa, Artificial Sequence
  Description of Artificial Sequence: Synthetic polypeptide
EVQLVESGGGVVQAGGSLRLSCVASGLTFSSYGMHWVRQAPGKGLEWVAVISYDGRSKFYADSVKGRFTISRDNSKNTLYLQMNSLRAEDAAVYYCANARVRDACSGTRCDKFGFYMDVWGKGTTVTVSS

SEQ ID NO: 4331 - protein, 126 aa, Artificial Sequence
  Description of Artificial Sequence: Synthetic polypeptide
EVQLVESGGDLVRPGGSLRLSCVASGFTFSNYWMHWVRQAPGQRPVWVSRTNTDGRNTAYADYAKGRFTISRDNAKSTLYLQLNSLRAEDTAVYFCARLRRNVADQITHNYYMDVWGKGTLVTVSS

SEQ ID NO: 4332 - protein, 114 aa, Artificial Sequence
  Description of Artificial Sequence: Synthetic polypeptide
EVQLVQSGGDIVQSGGSLRLSCAASGFVFSSNWMHWVRQRPGKGLEWISLINVDGRTTKYADSVKGRFTISRDNAKKTVYLQMDSLRAEDTAVYYCVKVEGLNWGPGTLVTVSS

SEQ ID NO: 4333 - protein, 122 aa, Artificial Sequence
  Description of Artificial Sequence: Synthetic polypeptide
EVQLVESGGGLVKPGGSLRVSCDVSGQRLSKAWMNWVRQTPTRGLEWVGLIKRDADGGTTEFAAPVEGRFTISRDDIQNTMTLHMTRLRVDDTGVYYCVAGDIGCIKENCRWGEGTTVTVSS

SEQ ID NO: 4334 - protein, 119 aa, Artificial Sequence
  Description of Artificial Sequence: Synthetic polypeptide
QVQLQESGPGLVKPSETLSLTCTVSGGSISSSYWSWIRQPPGQGLEWIGYIYYSGNTYYNPSLKSRVTISIDTSKTQFSLNLTSVSAADTAVYYCARDGIPGAIGMDVWGQGTTVTVSS

SEQ ID NO: 4335 - protein, 123 aa, Artificial Sequence
  Description of Artificial Sequence: Synthetic polypeptide
EVQLVESGAEVKKPGASVTLSCKASGYTFTAYYIHWVRQAREQGLEWMGVINPSTGTTFYAQNFPDRVSVTRDTSTSTVFMELHNLKSEDTAVYYCARAISEHGSGSYSPYYWGQGTLVTVSS

SEQ ID NO: 4336 - protein, 119 aa, Artificial Sequence
  Description of Artificial Sequence: Synthetic polypeptide
EVQLVQSGGGLGHPGGSLRLSCAGSGFTFSSYSMHWLRQAPGKGLKWVSAIGTAGGTYYADSVKGRFTISRDNAKNSFYLQMNSLRAEDMAVYYCAREYFFGSGNYGYWGQGTLVTASS

SEQ ID NO: 4337 - protein, 112 aa, Artificial Sequence
  Description of Artificial Sequence: Synthetic polypeptide
QVQLQQWGAGLLKPSETLSLTCAVYGGSFSGYYWNWIRQPPGKGLEWIGEIHQSGGPHYNPSLKSRVTISVDTSKNQFSLKLSSVTAADTAVYYCTELDDYWGQGTLVTVSS

SEQ ID NO: 4338 - protein, 119 aa, Artificial Sequence
  Description of Artificial Sequence: Synthetic polypeptide
QVQLVQSGAEVKKPGSSVKVSCKASGGTFNNFVIGWVRQAPGQGLEWMGRIIPILDIANYAQKFQGRVTITADKSTSTVYMELNSLRSEDTAVYYCARTGNYYKPYDYWGQGTLVTVSS

SEQ ID NO: 4339 - protein, 119 aa, Artificial Sequence
  Description of Artificial Sequence: Synthetic polypeptide
QVQLVQSGAEVKKPGSSVKVSCKASGGTFNNFVIGWVRQAPGQGLEWMGRIIPILDIANYAQKFQGRVTITADKSTSTAYMELSSLRSEDTAVYYCARTGNYYKPYDYWGQGTLVTVSS

SEQ ID NO: 4340 - protein, 112 aa, Artificial Sequence
  Description of Artificial Sequence: Synthetic polypeptide
EVQLVESGGGLVQPGGSLRLSCAASGFTFSRYWMSWVRQAPGKGLEWMANIKQDGSETHYVDSVKGRFTISRDNAKNSLYLQMNSLRAEDTAVYYCAIGDYWGQGTLVTVSS

SEQ ID NO: 4341 - protein, 112 aa, Artificial Sequence
  Description of Artificial Sequence: Synthetic polypeptide
EVQLVESGGGLVQPGGSLRLSCAASGFTFSRYWMSWVRQAPGKGLEWVANIKQDGSETHYVDSVKGRFTISRDNAKNSLYLQMNSLRAEDTAVYYCAIGDYWGQGTLVTVSS

SEQ ID NO: 4342 - protein, 117 aa, Artificial Sequence
  Description of Artificial Sequence: Synthetic polypeptide
QVQLVQSGAEVKTPGASVKVSCKASGYTFTSFGISWVRQAPGQGLEWMGWISVYNDYTNYAQKFQGRVTMTTDTSTSTAYMELRSLRSDDTAMYYCARKRGGDMDYWGQGTLVTVSS

SEQ ID NO: 4343 - protein, 117 aa, Artificial Sequence
  Description of Artificial Sequence: Synthetic polypeptide
QVQLVQSGAEVKKPGASVKVSCKASGYTFTSFGISWVRQAPGQGLEWMGWISVYNDYTNYAQKFQGRVTMTTDTSTSTAYMELRSLRSDDTAVYYCARKRGGDMDYWGQGTLVTVSS

SEQ ID NO: 4344 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGSGWYGNYFDYWGQGTLVTVSS

SEQ ID NO: 4345 - protein, 119 aa, Artificial Sequence
  Description of Artificial Sequence: Synthetic polypeptide
EVQLVQSGGGLVKPGGSLRLSCAGSGFTFSSYSMHWLRQAPGKGLEWVSAIGTAGGTYYADSVKGRFTISRDNAKNSLYLQMNSLRAEDTAVYYCAREYFFGSGNYGYWGQGTLVTVSS

SEQ ID NO: 4346 - protein, 116 aa, Artificial Sequence
  Description of Artificial Sequence: Synthetic polypeptide
EVQLVESGGGLVQPGGSLRLSCAASGFTFSSFWMSWVRQAPGKGLEWVANIKHDGSEQDYVDSVKGRFTISRDNAKNSLYLQMNSLRAEDTAVYYCARGGIWFGPWGQGTLVTVSS

SEQ ID NO: 4347 - protein, 120 aa, Artificial Sequence
  Description of Artificial Sequence: Synthetic polypeptide
EVQLVQSGGGLVHPGGSLRLSCAGSGFTFSRYALHWVRQAPGKGLEWVSAIGIGGGTFYADSVKGRFTISRDNAKNSLYLQMNSLRAEDMAVYYCARDTYYDFFDAFDIWGQGTMVTVSS

SEQ ID NO: 4348 - protein, 121 aa, Artificial Sequence
  Description of Artificial Sequence: Synthetic polypeptide
QVQLVQSGAEVKKPGSSVKVSCKASGGSFSIYVISWVRQAPGQGLEWMGRIIPILGTTNYAQKFQGRVTITADKSTSTAYMELSSLRSEDTAVYYCARPDSPNHSNTFDYWGQGTLVTVSS

SEQ ID NO: 4349 - protein, 118 aa, Artificial Sequence
  Description of Artificial Sequence: Synthetic polypeptide
QVQVVQSGAEVKKPGSSVKVSCKASGGTFSSYAISWVRQAPGQGLEWMGRIIPILGTAKYAQKFQGRVTIIADKSTSTAYMELSSLRSEDTAVYYCARDQDYYGMDVWGQGTTVTVSS

SEQ ID NO: 4350 - protein, 120 aa, Artificial Sequence
  Description of Artificial Sequence: Synthetic polypeptide
EVQLVQSGGGLVKPGGSLRLSCAGSGFTFSRYALHWVRQAPGKGLEWVSAIGIGGGTFYADSVKGRFTISRDNAKNSLYLQMNSLRAEDTAVYYCARDTYYDFFDAFDIWGQGTMVTVSS

SEQ ID NO: 4351 - protein, 117 aa, Artificial Sequence
  Description of Artificial Sequence: Synthetic polypeptide
QVQLVESGGGVVQPGRSLRLSCAASGFTFSNYGIHWVRQAPGKGLEWVAIIWHDGSNSYYVDSVKGRFTMSRDNSKNTVYLQMNSLRAEDTAVYFCARIIGGAFDIWGQGTMVTVSS

SEQ ID NO: 4352 - protein, 117 aa, Artificial Sequence
  Description of Artificial Sequence: Synthetic polypeptide
QVQLVESGGGVVQPGRSLRLSCAASGFTFSNYGIHWVRQAPGKGLEWVAIIWHDGSNSYYVDSVKGRFTISRDNSKNTLYLQMNSLRAEDTAVYFCARIIGGAFDIWGQGTMVTVSS

SEQ ID NO: 4353 - protein, 119 aa, Artificial Sequence
  Description of Artificial Sequence: Synthetic polypeptide
QVQLVESGGGVVQPGRSLRLSCAASGFTFRSYGMHWVRQAPGKGLEWVTLIWYDGSNKYYADSVKGRFTISRDNSKNTLYLQMNSLRVEDTAVYYCAREGFNWDAFDIWGQGTMVTVSS

SEQ ID NO: 4354 - protein, 119 aa, Artificial Sequence
  Description of Artificial Sequence: Synthetic polypeptide
QVQLVESGGGVVQPGRSLRLSCAASGFTFRSYGMHWVRQAPGKGLEWVTLIWYDGSNKYYADSVKGRFTISRDNSKNTLYLQMNSLRAEDTAVYYCAREGFNWDAFDIWGQGTMVTVSS

SEQ ID NO: 4355 - protein, 115 aa, Artificial Sequence
  Description of Artificial Sequence: Synthetic polypeptide
EVHLVESGGGLVQSGGSLRLSCAASGFSISGYWMSWVRQAPGKGLEWVANIKQDGGEKYYGDSVKGRFTISRDNAENSLYLQMSSLRAEDTAVYYCVMAGGLDYWGQGALVTVSS

SEQ ID NO: 4356 - protein, 115 aa, Artificial Sequence
  Description of Artificial Sequence: Synthetic polypeptide
EVQLVESGGGLVQPGGSLRLSCAASGFSISGYWMSWVRQAPGKGLEWVANIKQDGGEKYYGDSVKGRFTISRDNAKNSLYLQMNSLRAEDTAVYYCVMAGGLDYWGQGTLVTVSS

SEQ ID NO: 4357 - protein, 112 aa, Artificial Sequence
  Description of Artificial Sequence: Synthetic polypeptide
QVQLQQWGAGLLKPSETLSLTCAVYGGSFSGYYWNWIRQPPGMGLEWIGEIHQSGGPHYNPSLKSRVSISVDTSKNQVNLKLSSVTAADTAIYYCTELDDYWGQGTLVTVSS

SEQ ID NO: 4358 - protein, 124 aa, Artificial Sequence
  Description of Artificial Sequence: Synthetic polypeptide
EVQLLESGGDLVQPGGSLRLSCAASGFTFSSQAMSWVRQAPGKGLEWVSALSRTGDYTWYADSVRGRFTVSRDDSKNIFYLEMNSLRAEDTAVYYCAKNYYSSFGYNWAAFHIWGQGTMVTVSS

SEQ ID NO: 4359 - protein, 114 aa, Artificial Sequence
  Description of Artificial Sequence: Synthetic polypeptide
EVQLVESGGGLVQPGGSLRISCTTSGFIFSDYWMHWVRQAPGKGLTWVSRINLDGSDTIYADSVKGRFTISRDNDKNTLYLQMNSLRVEDTAIYYCARSRKSVWGQGTMVTVSS

SEQ ID NO: 4360 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTIIRLEPEDFAVYYCQQYGSSPFTFGQGTKVEIK

SEQ ID NO: 4361 - protein, 112 aa, Artificial Sequence
  Description of Artificial Sequence: Synthetic polypeptide
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPVTFGGGTKVEIK

SEQ ID NO: 4362 - protein, 112 aa, Artificial Sequence
  Description of Artificial Sequence: Synthetic polypeptide
DVVMTQSPLSLPVTLGQSASISCRSSQGLVHSDGNTYLNWFHQRPGQSPRRLIYKVFNRDSGVSDRFSGSGSGSDFTLMISRVEAEDVGIYYCMQGTLWPLTFGQGTKVEIK

SEQ ID NO: 4363 - protein, 113 aa, Artificial Sequence
  Description of Artificial Sequence: Synthetic polypeptide
DIVMTQSPDSLAVSLGERATINCKSGQSVLYRSNNRNYIAWYQQKPGQPPKLLIYWASTRESGVPDRFSGSGSGTDFTLTISSLQAEDVAVYYCQQYYSNRWTFGQGTKVEIK

SEQ ID NO: 4364 - protein, 110 aa, Artificial Sequence
  Description of Artificial Sequence: Synthetic polypeptide
QSVLTQPPSASGTPGQRVTISCSGSSSNIGGNTVNWYHQLPGTAPKLLVYSTNQRPSGVPDRFSGSKSGTSASLAISGLQAEDEADYYCATWDDSLNGWVFGGGTKLTVL

SEQ ID NO: 4365 - protein, 113 aa, Artificial Sequence
  Description of Artificial Sequence: Synthetic polypeptide
DIVMTQSPDSLAVSLGERATINCKSSQSVLYNSDNKNYLAWLQQKPGQPPKVLIYWASTREFGVPDRFSGSGSGTDFTLTISSLQAEDVAVYYCHQYYSVPFTFGGGTKVEIK

SEQ ID NO: 4366 - protein, 108 aa, Artificial Sequence
  Description of Artificial Sequence: Synthetic polypeptide
QSALTQPASVSGSPGQSITISCTGTSSDIGTHNLVSWYQQHPGKAPKLIIYEIFERPSGISSRFTGSKSGNTASLTISGLQAEDEADYFCCAYSVTVIFGGGTKLTVL

SEQ ID NO: 4367 - protein, 119 aa, Artificial Sequence
  Description of Artificial Sequence: Synthetic polypeptide
QVQLVQSGAEVKKPGASVKVSCKTSGYSFTSYTLHWVRQAPGHRPEWMGWINAAFINTKYSQKFQGRITLTRDTSANIAYLELRSLTTEDTAVYYCARRASGSNGLDVWGQGTTVTVSS

SEQ ID NO: 4368 - protein, 108 aa, Artificial Sequence
  Description of Artificial Sequence: Synthetic polypeptide
SYELTQPPSVSVSPGQTATISCSGDALPKRYAYWYKQKSGQVPVLIIYEDNKRPSGIPARFSGSSSGTMATLTITGAQVDDEADYYCYSSDNSDTYSVFGGGTKLTVL

SEQ ID NO: 4369 - protein, 108 aa, Artificial Sequence
  Description of Artificial Sequence: Synthetic polypeptide
EIVLTQSPGTLSLSPGERATLSCRASQTISNNYLAWYQQKPGQAPRLLVYAASSRATGIPDRFYGSGSGADFTLTISRLEPEDFVVYYCQQYGSSPITFGQGTRLEIK

SEQ ID NO: 4370 - protein, 111 aa, Artificial Sequence
  Description of Artificial Sequence: Synthetic polypeptide
QSALTQPPSASGSPGQSVTISCTGTSSDVGGYNYVSWYQHQPGKAPKLMIYEVSKRPSGVPDRFSGSKSGNTASLTVSGLQAEDEADYYCSSYAGSNNLGVFGTGTEVTVL

SEQ ID NO: 4371 - protein, 104 aa, Artificial Sequence
  Description of Artificial Sequence: Synthetic polypeptide
EIVLTQSPGTLSLSPGETVTLSCRASQSVSSSNLAWYQQKPGQAPRLLIYGASSRATGIPDRFSGRGSGTDFTLTISRLEPEDFAVYYCQHYGTFGQGTKVDIK

SEQ ID NO: 4372 - protein, 107 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDTATYYCQQYDNLPLTFGGGTKVEIK

SEQ ID NO: 4373 - protein, 110 aa, Artificial Sequence
  Description of Artificial Sequence: Synthetic polypeptide
QSVLTQPPSASGTPGQRVTISCSGSSSNIGSNNVYWYQQLPGTAPKLLVYRNNQRPSGVPDRVSGSKSGSSASLAISGLRSEDEADYYCAAWDDSLRGYVFGTGTKVTVL

SEQ ID NO: 4374 - protein, 113 aa, Artificial Sequence
  Description of Artificial Sequence: Synthetic polypeptide
DVVMTQSPLSLPVTLGQPASISCRSSQSLVHSDGNTYLNWFQQRPGQSPRRLIYKVSHRDSGVPDRFSGSGSGTDFTLKISRVEAEDVGVYYCLQGTHWPPFTFGQGTKLEIK

SEQ ID NO: 4375 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISERFSGVPDRFSGSGAGTDFTLKISRVEAEDVGVYYCMQVTQFPITFGQGTRLEIK

SEQ ID NO: 4376 - protein, 112 aa, Artificial Sequence
  Description of Artificial Sequence: Synthetic polypeptide
DIVMTQTPLSSPVTLGQPASISCRSSQSLVHTDGKTYLSWLHQRPGQPPRPLIYKMSKRFSGVPDRFSGSGAETEFTLKISRVEAEDVGIYYCLQLTQFPITFGQGTRLEIK

SEQ ID NO: 4377 - protein, 111 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSFDSSLSSSVFGGGTKLTVL

SEQ ID NO: 4378 - protein, 121 aa, Artificial Sequence
  Description of Artificial Sequence: Synthetic polypeptide
QVQLVESGGGVVQPGKSLRLSCAASGFTFRDHGMHWVRQAPGKGLEWVAVIWLDGSSRFYADSVEGRFTISRDNSKNTLYLQLTSLRAEDTAIYYCARDRVASEGTAFDVWGQGTMVTVSS

SEQ ID NO: 4379 - protein, 122 aa, Artificial Sequence
  Description of Artificial Sequence: Synthetic polypeptide
DVVMTQSPDSLAVSLGERATINCKSSQSVLSSSKNKNHLAWYQQKPGQPPKLLIYWASTRESGYWASTRESGVPDRFSGSGSGTDFTLTISSLQAEDVAVYYCQQYYSPSVTFGGGTKVEIK

SEQ ID NO: 4380 - protein, 119 aa, Artificial Sequence
  Description of Artificial Sequence: Synthetic polypeptide
QVQLVQSGTAVKKPGASVKVSCKASGFSFNGYYMHWVRQAPGQGLEWMGVINPNGGSTNYAQKFKGRITMSADTPARSVSMELGSLRSDDTAMYYCARLPVNIEVLDLWGQGTLVTVSS

SEQ ID NO: 4381 - protein, 134 aa, Artificial Sequence
  Description of Artificial Sequence: Synthetic polypeptide
QVQLVQSGAEVKKPGASVKVSCKASGYTFTNYYMHWVRQAPGQGLEWMGIINPSGGRTSYAQKFQGRASMTRDTSTSTVYMEVISLRSEDTAVYYCARQRPSGYSGYGPSESYGNPTDDAFDVWGQGTTVTVSS

SEQ ID NO: 4382 - protein, 130 aa, Artificial Sequence
  Description of Artificial Sequence: Synthetic polypeptide
QVQLVESGGGVVQPGRSLRLSCAASGFTFSNYVMYWVRQAPGKGLEWVAFISYDGSNKYYPDSVKGRFTISRDNSMNTLYLQMDSLRAEDTAVYYCARDTYQYDSSTYYPYFYYYGMDVWGQGTTVTVSS

SEQ ID NO: 4383 - protein, 111 aa, Artificial Sequence
  Description of Artificial Sequence: Synthetic polypeptide
QSALTQPASVSGSPGQSITISCIGTSSDVGGYNYVSWYQQHPGKAPKLMIYEVSNRPSGVSSRFSGSKSGNTASLTISGLQSEDEADYYCSSFASSSTSVTFGGGTKLTVL

SEQ ID NO: 4384 - protein, 110 aa, Artificial Sequence
  Description of Artificial Sequence: Synthetic polypeptide
QSALTQPRSVSGSPGQSITISCTGTSSNVGTYKFVSWYQQHPGKAPKLMIYDVTKRPSGVPDRFSGSKSGNTASLTISGLQAEDEADYYCCSYAGSYTYVFGSGTKVTVL

SEQ ID NO: 4385 - protein, 113 aa, Artificial Sequence
  Description of Artificial Sequence: Synthetic polypeptide
DVVMTQSPLSLPVTLGQPASISCRSSQSLVHSDGVTYLNWFQQRPGQSPRRLIYKVSNRDSGVPDRFSGSGSGTDFTLEISRVEAEDVGIYYCMQGTHWPPWTFGQGTKVEIK

SEQ ID NO: 4386 - protein, 108 aa, Artificial Sequence
  Description of Artificial Sequence: Synthetic polypeptide
EIVLTQSPGTLSLSPGERATLSCRASQAVTNNYLAWYQQKPGQAPRLLVYAASSRATGIPDRFYGSGSGADFTLTISRLEPEDFAVYYCQQYGTSPITFGQGTRLEIK

SEQ ID NO: 4387 - protein, 123 aa, Artificial Sequence
  Description of Artificial Sequence: Synthetic polypeptide
QVQLVQSGAEVKKPGASVKVSCKASGYTFTSYRIHWVRQAPGQGLEWMGEIYPSNARTNYNEKFKSRVTMTRDTSTSTVYMELSSLRSEDTAVYYCARKYYYGNTRRSWYFDVWGQGTTVTVS

SEQ ID NO: 4388 - protein, 217 aa, Artificial Sequence
  Description of Artificial Sequence: Synthetic polypeptide
QSALTQPASVSGSPGQSITISCTGTSSDVGSYNYVNWYQQHPGKAPKLMIYGVSKRPSGVSNRFSGSKSGNTASLTISGLQAEDEADYYCGTFAGGSYYGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4389 - protein, 217 aa, Artificial Sequence; identical to SEQ ID NO: 4388
  Description of Artificial Sequence: Synthetic polypeptide

SEQ ID NO: 4390 - protein, 111 aa, Artificial Sequence
  Description of Artificial Sequence: Synthetic polypeptide
QSVLTQPPSVSGAPGQRVTISCTGSSSNIGDGYDVHWYQQLPGTAPKLLIYGNSHRPSGVPDRFSGSKSDTSASLAITGLQVEDEADYFCHSYDGSVSGWIFGGGTKLTVL

SEQ ID NO: 4391 - protein, 105 aa, Artificial Sequence
  Description of Artificial Sequence: Synthetic polypeptide
SYELTQPPSVSVSPGQTATITCSGHALGDKFVSWYQQGSGQSPVLVIYDDTQRPSGIPGRFSGSNSGNTATLTISGTQAMDEADYFCQAWDSSFVFGGGTKVTVL

SEQ ID NO: 4392 - protein, 112 aa, Artificial Sequence
  Description of Artificial Sequence: Synthetic polypeptide
QSVLTQPPSVSGAPGQRVTISCTGSSSNIGAGYDVHWYQQLPGAAPKLLIRGNGNRPSGVPDRFSVSKSGYSASLAITGLQPADEGVYYCQSYDSSLSGSKVFGQGTKLTVL

SEQ ID NO: 4393 - protein, 214 aa, Artificial Sequence
  Description of Artificial Sequence: Synthetic polypeptide
DIQMTQSPASLSASVGDRVTITCRASQDISDYLAWYQQKPGKIPRLLIYTTSTLQSGVPSRFRGSGSGTDFTLTISSLQPEDVATYYCQKYDSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4394 - protein, 214 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPSRFSGSGSGTDFTLTISSLQPEDFATYYCQQHYSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4395 - protein, 219 aa, Artificial Sequence
  Description of Artificial Sequence: Synthetic polypeptide
DIVMTQSPDSLAVSLGERATINCKSSHSVLYSSNQKNYLAWYQQKPGQPPKLLIYWASTRESGVPDRFSGSGSGTDFTLTISSLQAEDVAVYYCHQYLSSLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4396 - protein, 215 aa, Artificial Sequence
  Description of Artificial Sequence: Synthetic polypeptide
EIVLTQSPGTLSLSPGERATLSCRASSSVSSSYLHWYQQKPGQAPRLLIYSTSNLVAGIPDRFSGSGSGTDFTLTISRLEPEDFAVYYCQHHSGYHFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4397 - protein, 214 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGQDYTLTISSLQPEDFATYYCLQSDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4398 - protein, 214 aa, Artificial Sequence
  Description of Artificial Sequence: Synthetic polypeptide
DIQMTQSPSSLSASVGDRVTITCKASQDINSYLSWFQQKPGKAPKTLIYRANRLVDGVPSKFSGSGSGTDYTLTISSLQPEDFATYYCLQSDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4399 - protein, 214 aa, Artificial Sequence
  Description of Artificial Sequence: Synthetic polypeptide
DIQMTQSPSSLSASVGDRVTITCKASQDINSYLSWFQQKPGKAPKTLIYRANRLVDGVPSKFSGSGSGQDYTLTISSLQPEDFATYYCLQSDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4400 - protein, 214 aa, Artificial Sequence
  Description of Artificial Sequence: Synthetic polypeptide
DIKMTQSPSSMYASLRERVTITCKASQDINSYLSWFQQKPGKSPKTLIYRANRLVDGVPSRFSGSGSGQDYSLTISSLEYEDMGIYYCLQCDEFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4401 - protein, 214 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGTDFTLTISSLQPEDFATYYCLQCDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4402 - protein, 214 aa, Artificial Sequence
  Description of Artificial Sequence: Synthetic polypeptide
DIQMTQSPSSLSASVRDRVTITCKASQDINSYLSWFQQKPGKAPKSLIYRANRLVDGVPSKFSGSGSGTDFTLTISSLQPEDFATYYCLQCDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4403 - protein, 214 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGTDYTLTISSLQPEDFATYYCLQCDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4404 - protein, 214 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGTDFTLTISSLQPEDFATYYCLQCDEFPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4405 - protein, 214 aa, Artificial Sequence; identical to SEQ ID NO: 4400
  Description of Artificial Sequence: Synthetic polypeptide

SEQ ID NO: 4406 - protein, 214 aa, Artificial Sequence; identical to SEQ ID NO: 4403
  Description of Artificial Sequence: Synthetic polypeptide

SEQ ID NO: 4407 - protein, 208 aa, Artificial Sequence
  Description of Artificial Sequence: Synthetic polypeptide
DIKMTQSPSSMYASLRERVTITCKASQDINSYLSWFQQKPGKSPKTLIYRANRLVDGVPSRFSGSGSGQDYSLTISSLEYEDMGIYYCLQSDEFPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKS

SEQ ID NO: 4408 - protein, 214 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGTDYTLTISSLQPEDFATYYCLQSDEFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4409 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTSTLQPGVPSRFSGSGSGTDFTFTISSLQPEDIATYYCLQYDNLLYTFGQGTKLEIK

SEQ ID NO: 4410 - protein, 107 aa, Artificial Sequence
  Description of Artificial Sequence: Synthetic polypeptide
  MOD_RES (52)..(53): Any amino acid
  MOD_RES (93)..(94): Any amino acid
DIQMTQSPSSLSASVGDRVTITCKASQDINKYVAWYQQKPGKAPKLLIYYTXXLQPGVPSRFSGSGSGTDFTFTISSLQPEDIATYYCLQYDXXLYTFGQGTKLEIK

SEQ ID NO: 4411 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTSFLQPGVPSRFSGSGSGTDFTFTISSLQPEDIATYYCLQYDNLLYTFGQGTKLEIK

SEQ ID NO: 4412 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTSWLQPGVPSRFSGSGSGTDFTFTISSLQPEDIATYYCLQYDNLLYTFGQGTKLEIK

SEQ ID NO: 4413 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTSFLQPGVPSRFSGSGSGTDFTFTISSLQPEDIATYYCLQYDALLYTFGQGTKLEIK

SEQ ID NO: 4414 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTKTLQPGVPSRFSGSGSGTDFTFTISSLQPEDIATYYCLQYDNLLYTFGQGTKLEIK

SEQ ID NO: 4415 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTRTLQPGVPSRFSGSGSGTDFTFTISSLQPEDIATYYCLQYDNLLYTFGQGTKLEIK

SEQ ID NO: 4416 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTSTLQPGVPSRFSGSGSGTDFTFTISSLQPEDIATYYCLQYDNKLYTFGQGTKLEIK

SEQ ID NO: 4417 - protein, 107 aa, Artificial Sequence; identical to SEQ ID NO: 4412
  Description of Artificial Sequence: Synthetic polypeptide

SEQ ID NO: 4418 - protein, 107 aa, Artificial Sequence
  Description of Artificial Sequence: Synthetic polypeptide
DIQMTQSPSSLSASVGDRVTITCKASQDINKYVAWYQQKPGKAPKLLIYYTSHLQPGVPSRFSGSGSGTDFTFTISSLQPEDIATYYCLQYDNLLYTFGQGTKLEIK

SEQ ID NO: 4419 - protein, 219 aa, Artificial Sequence
  Description of Artificial Sequence: Synthetic polypeptide
DIVMTQSPLSNPVTLGQPVSISCRSSKSLLYKDGKTYLNWFLQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4420 - protein, 214 aa, Artificial Sequence
  Description of Artificial Sequence: Synthetic polypeptide
SSELTQDPAVSVALGQTVRITCQGDSLRKYYGSWYQQKPGQAPVLVIYEDSRRPSGVPDRFSGSIDSSSNSASLTISGLKTDDEADYYCQSYDSSNVVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4421 - protein, 107 aa, Artificial Sequence [sequence omitted]

SEQ ID NO: 4422 - protein, 113 aa, Artificial Sequence
  Description of Artificial Sequence: Synthetic polypeptide
DIVMTQSPDSLAVSLGERATINCKSSQSLLNSANQKNYLAWYQQKPGQPPKLLIYFASTRESGVPDRFSGSGSGTDFTLTISSLQAEDVAVYYCQQHYNTPLTFGGGTKVEIK

SEQ ID NO: 4423 - protein, 107 aa, Artificial Sequence
  Description of Artificial Sequence: Synthetic polypeptide
DIEMTQSPSSLSASVGDRVTITCKASQDVSTAVAWYQQKPGKAPKLLIYSASYRYTGVPDRFSGSGSGTDFTLTISSLQAEDFATYYCQQHYSTPWTFGQGTKVEIK

SEQ ID NO: 4424 - protein, 107 aa, Artificial Sequence
  Description of Artificial Sequence: Synthetic polypeptide
DIQMTQSPSSLSASVGDRVTITCKASQDVSTAVAWYQQKPGKAPKLLIYSASYRYTGVPSRFSGSGSGTDFTLTISSLQPEDFATYYCQQHYSTPWTFGQGTKVEIK

SEQ ID NO: 4425 - protein, 107 aa, Artificial Sequence
  Description of Artificial Sequence: Synthetic polypeptide
DIQMTQSPASLSASVGDRVTITCRASQDISDYLAWYQQKPGKIPRLLIYTTSTLQSGVPSRFRGSGSGTDFTLTISSLQPEDVATYYCQKYDSAPLTFGGGTKVEIK

SEQ ID NO: 4426 - protein, 105 aa, Artificial Sequence; identical to SEQ ID NO: 4391
  Description of Artificial Sequence: Synthetic polypeptide

SEQ ID NO: 4427 - protein, 107 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGTDYTLTISSLQPEDFATYYCLQCDEFPLTFGQGTKLEIK

SEQ ID NO: 4428 - protein, 107 aa, Artificial Sequence
  Description of Artificial Sequence: Synthetic polypeptide
DIKMTQSPSSMYASLRERVTITCKASQDINSYLSWFQQKPGKSPKTLIYRANRLVDGVPSRFSGSGSGQDYSLTISSLEYEDMGIYYCLQSDEFPLTFGAGTKLELK

SEQ ID NO: 4429 - protein, 107 aa, Artificial Sequence
  Description of Artificial Sequence: Synthetic polypeptide
DIQMTQSPSSLSASVGDRVTITCKASQDINSYLSWFQQKPGKAPKSLIYRANRLVDGVPSKFSGSGSGTDYTLTISSLQPEDFATYYCLQSDEFPLTFGQGTKLEIK

SEQ ID NO: 4430 - protein, 124 aa, Artificial Sequence
  Description of Artificial Sequence: Synthetic polypeptide
EVQLQQSGPELVKPGASVKISCKASGYSFTGYFMHWVKQSHGNILDWIGNIYPYNGVSNYNQRFKAKATLTVDKSSSTAYMELRSLTSEDSAVYYCARRYYYGTGPADWYFDVWGTGTTVTVSS

SEQ ID NO: 4431 - protein, 108 aa, Artificial Sequence
  Description of Artificial Sequence: Synthetic polypeptide
SSELTQDPAVSVALGQTVRITCQGDSLRKYYGSWYQQKPGQAPVLVIYEDSRRPSGVPDRFSGSIDSSSNSASLTISGLKTDDEADYYCQSYDSSNVVFGGGTQLTVL

SEQ ID NO: 4432 - protein, 107 aa, Artificial Sequence
  Description of Artificial Sequence: Synthetic polypeptide
SYVLTQPPSVSVSLGQMAAITCSGEALPKKYGYWYQQKPGQVPVLLIYRDVERPSGVPDRFSGSSSGTMVTLTISGVQAEDEADYYCLSADSSGTWVFGGGTKLTVL

SEQ ID NO: 4433 - protein, 107 aa, Artificial Sequence
  Description of Artificial Sequence: Synthetic polypeptide
EIVLTQSPSSLSASVGDTVTITCRSSQNISNYLSWFQHKPGKAPRILVYAASTLQTGVPSRFSGRGSGTIFTLSITSLQSEDYATYYCQQNDKIPRTFGQGTKVEIK

SEQ ID NO: 4434 - protein, 108 aa, Artificial Sequence
  Description of Artificial Sequence: Synthetic polypeptide
SYVLTQPPSVSVSAGQTASITCSADMLGDTYVSWYQKRPGQSPVLLIYQDSKRPSEIPERFSGSSSEDTATLTITGTQALDEAAYYCQVWDRRTTTYVFGPGTEVTVL

SEQ ID NO: 4435 - protein, 107 aa, Artificial Sequence
  Description of Artificial Sequence: Synthetic polypeptide
EIVLTQSPPTLSLSPGERATLSCRASQTVSKYLAWYQQKPGQAPRLLVYDTSNRAIGIPPRFSGSGSGTDFTLTISTLEPEDFALYYCQQRSNWPPTFGQGTRLEIK

SEQ ID NO: 4436 - protein, 107 aa, Artificial Sequence
  Description of Artificial Sequence: Synthetic polypeptide
DIQMTQSPSTLSASVGDRVTITCRASQSISRWLAWYQQRPGRAPDLLIYDASNLESGVPSRFSGSGSGTEFTLTISSLQPGDFATYYCQQYYSYVYTFGQGTKLEIK

SEQ ID NO: 4437 - protein, 108 aa, Artificial Sequence
  Description of Artificial Sequence: Synthetic polypeptide
SYELTQPPSVSVSPGQTARITCSGDALPKQFAYWYQQKSGQAPKLVIFKDTERPSGIPERFSASSSGTKATLTISGVQAEDEADYYCQSADRTATSWVFGGGTKLTVL

SEQ ID NO: 4438 - protein, 107 aa, Artificial Sequence
  Description of Artificial Sequence: Synthetic polypeptide
SYELTQPPSVSVSPGQTARITCSGDALAKQYSYWYQHKPGQAPVMVMYKDRERPSGIPERFSGSSSGTTVTLTISAVQAEDEADYYCQSTGTDSPYIFGTGTKVTVL

SEQ ID NO: 4439 - protein, 108 aa, Artificial Sequence
  Description of Artificial Sequence: Synthetic polypeptide
SYVLTQPPSVSVSPGQTARITCSGDALPKKYAYWYQQKSGQAPVLVIYEDIKRPSGIPERFSGSSSGTMATLTISGAQVEDEGDYYCYSADRSGNRWAFGGGTKLTVL

SEQ ID NO: 4440 - protein, 107 aa, Artificial Sequence
  Description of Artificial Sequence: Synthetic polypeptide
LPVLTQPPSVSVSPGQTARITCSGDELSKQYAYWYQKKSGQAPVMVVNEDTKRPPGIPERFSGSSSGTTSTLTISGVQAEDEADYYCQSADITGSWVFGGGTKLTVL

SEQ ID NO: 4441 - protein, 108 aa, Artificial Sequence
  Description of Artificial Sequence: Synthetic polypeptide
SYELTQPPSVSVSPGQTARITCSGDALPTKFAFWYQQKSGQAPVLVIYEDDKRPSGIPQRFSGSSSGTTATLTISGAQEEDDADYYCYSKDSTNVERVFGTGTKLSVL

SEQ ID NO: 4442 - protein, 110 aa, Artificial Sequence
  Description of Artificial Sequence: Synthetic polypeptide
QSVLTQPPSVSAAPGQKVNISCSGSSSNIGNNYVSWYQRLPGTAPKLLIYDNNKRPSGIPDRFSGSKSGTSATLGITGLQTGDGADYYCATWDKSLIAVVFGGGTKLTVL

SEQ ID NO: 4443 - protein, 111 aa, Artificial Sequence
  Description of Artificial Sequence: Synthetic polypeptide
EIVLTQSPGSLAVSLGERATINCKSSQTVLYNNKNYLAWYQQKPGQPPKLLISWASSRESGVPDRFSGSGSGTDFTLTISSLQAEDVAVYYCQHYYGTPVTFGGGTKVEIK

SEQ ID NO: 4444 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPRTFGQGTKVEIK

SEQ ID NO: 4445 - protein, 107 aa, Artificial Sequence
  Description of Artificial Sequence: Synthetic polypeptide
EIVLTQSPDFQSVTPKEKVTITCRASQSIGSSLHWYQQKPDQSPKLLIKYASQSFSGVPSRFSGSGSGTDFTLTINSLEAEDAAAYYCHQSSSLPITFGQGTRLEIK

SEQ ID NO: 4446 - protein, 107 aa, Artificial Sequence
  Description of Artificial Sequence: Synthetic polypeptide
DIQMTQSPSSLSASVGDRVTITCRASQDISSWLAWYQQKPEKAPKSLIYAASSLQSGVPSRFSGSGSGTDFTLTISSLQPEDFATYYCQQYKSYPLTFGGGTKVEIK

SEQ ID NO: 4447 - protein, 107 aa, Artificial Sequence
  Description of Artificial Sequence: Synthetic polypeptide
DIQMTQSPSSVSASVGDRVTITCRASQDISSWLAWYQHKPGKAPKLLIYLASSLQSGVPSRFSGSGSGTDFTLTISSLQPEDFATYYCQQANSFPWTFGQGTKVEIK

SEQ ID NO: 4448 - protein, 108 aa, Artificial Sequence
  Description of Artificial Sequence: Synthetic polypeptide
EIVLTQSPGTLSLSPGERATLSCRASQSFSRGYLAWYQQKPGQAPRLLIYGASSRVTGIPDRFSGSGSGTDFTLTISRLEPEDFAVYYCQQYDSSPYTFGQGTKLEIK

SEQ ID NO: 4449 - protein, 107 aa, Artificial Sequence
  Description of Artificial Sequence: Synthetic polypeptide
VIWMTQSPSLLSASTGDRVTISCRMSQGISSYLAWYQQKPGKAPEVLIYAVSTLQSGVPSRFSGSGSGTDFTLTISCLQSEDFATYYCQQYYSFPYTFGQGTKLEIK

SEQ ID NO: 4450 - protein, 107 aa, Artificial Sequence
  Description of Artificial Sequence: Synthetic polypeptide
VIWMTQSPSLLSASTGDRVTISCRMSQGISSYLAWYQQKPGKAPELLIYAVSTLQSGVPSRFSGSGSGTDFTLTISSLQSEDFATYYCQQYYSFPYTFGQGTKLEIK

SEQ ID NO: 4451 - protein, 107 aa, Artificial Sequence
  Description of Artificial Sequence: Synthetic polypeptide
DIQMTQSPSSLSASVGDRVTITCRASQGISSWLAWYQQKPEKAPKSLIYGASSLQSGVPSRFSGSGSGTDFTLTISSLQPEDFATYYCQQYNSYPYTFGQGTKLEIK

SEQ ID NO: 4452 - protein, 107 aa, Artificial Sequence
  Description of Artificial Sequence: Synthetic polypeptide
DIQMTQSPSSVSASVGDRVTITCRASQGISSWLAWYQHKPGKAPKLLIYAASSLQSGVPSRFSGSGSGTDFTLTISSLQPEDFATYYCQQTNNFPWTFGQGTKVEIK

SEQ ID NO: 4453 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYDSYPLTFGGGTKVEIK

SEQ ID NO: 4454 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPITFGQGTRLEIK

SEQ ID NO: 4455 - protein, 108 aa, Artificial Sequence
  Description of Artificial Sequence: Synthetic polypeptide
EIVLTQSPGTLSLSPGERATLSCRASQSVRISYLAWYQQKPGQAPRLLIYGTFSRATGIPDRFSGSGSGTDFTLTISRLEPEDFAVYYCQQYGSSMYTFGQGTKLEIK

SEQ ID NO: 4456 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWYTFGQGTKLEIK

SEQ ID NO: 4457 - protein, 107 aa, Artificial Sequence [sequence omitted]

SEQ ID NO: 4458 - protein, 107 aa, Artificial Sequence
  Description of Artificial Sequence: Synthetic polypeptide
EIVLTQSPATLSLSPGERATLSCRASQSVSSYLAWYQQKPGQAPRLLIYNASNRATGIPARFSGSGSGTDFTLTIGSLEPEDFAVYYCQQRSNWPRTFGQGTKVEIK

SEQ ID NO: 4459 - protein, 113 aa, Artificial Sequence
  Description of Artificial Sequence: Synthetic polypeptide
EVQLVESGGGLVQPGGSLRLSCAASGFTFSSYRMNWVRQAPGKGLEWVSYISTSSSTIYYADSVKGRFTISRDNAKNSLYLQMNSLRAEDTAVYYCARAFDYWGQGTLVTVSS

SEQ ID NO: 4460 - protein, 113 aa, Artificial Sequence
  Description of Artificial Sequence: Synthetic polypeptide
EVQLVESGGGLVQPGGSLRLSCAASGFTFSTYYMSWVRQAPGKGLEWVANIKQDGSEKYYVDSVKGRFTISRDNARNSLYLQMHSLRAEDTAVYYCASPPGWWGQGTLVTVSS

SEQ ID NO: 4461 - protein, 110 aa, Artificial Sequence
  Description of Artificial Sequence: Synthetic polypeptide
QSALTQPASVSGSPGQSITISCTGSNTDVGAYDYVSWSQQLPGKAPKFVIFDVDVRPSGISDRFSGSKSGNTASLTISGLQAEDEADYYCSSYTKSGTLVFGGGTKVTVV

SEQ ID NO: 4462 - protein, 119 aa, Artificial Sequence
  Description of Artificial Sequence: Synthetic polypeptide
QVQLVQSGAEVKKPGASVKVSCKASGYIFTDYFIHWIRQAPGQGLEWMGWIKPKSGGTDYAEKFQGRVTLTRDTSITTVYMELSRLNSDDTAVYYCARLKYSVPDSDYWGQGTLVTVSS

SEQ ID NO: 4463 - protein, 126 aa, Artificial Sequence
  Description of Artificial Sequence: Synthetic polypeptide
EVQLVESGGGLVKPGGSLRLSCATSGFNFSNVWISWVRQAPGKGLEWVGRIKSKNDGGTTEYAAPVKGRFTISRDDSKNTVYLQMNSLKTEDAGVYYCTTDPYHYFDMGGPGFGPWGQGTLVTVSS

SEQ ID NO: 4464 - protein, 123 aa, Artificial Sequence
  Description of Artificial Sequence: Synthetic polypeptide
EVQLLESGGALVQPGGSLRLSCAASGLTFSRHAFSWVRQAPGKGLEWVAISSGSGGNTYYAASVKGRFTISRDESKNTLYLQMNSLRVEDTALYYCAKEVLEWSLLSRYMDVWGKGTTVTVSS

SEQ ID NO: 4465 - protein, 112 aa, Artificial Sequence
  Description of Artificial Sequence: Synthetic polypeptide
QVQLQESGPGLVKPSETLSLTCTVSGGSITDYYWSWIRQPPGKGLEWIGYIHDSGTTRYNPSLTSRLSMSLDTSTNQVSLRLTSVTAADTAVYYCAKVPDYWGQGTLVTVSS

SEQ ID NO: 4466 - protein, 116 aa, Artificial Sequence
  Description of Artificial Sequence: Synthetic polypeptide
QVQLQESGPGVVKPSQTLSLTCTVSGVSVGSGDYYWSWIRHHPGKGLEWIGYISFFGSSNYNPSLKGRVSMSVDTSNNQFSLNLKSVTAADTAVYFCATGNAYSFWGQGTMVTVSS

SEQ ID NO: 4467 - protein, 112 aa, Artificial Sequence
  Description of Artificial Sequence: Synthetic polypeptide
EVQLVESGGDLVQPGGSLRLSCTASGFNLGDYWMHWVRQVPGKGLVWVSRISSDGASVSYADFVEGRFTISRGNARNTLFLELNSLRLDDTAVYYCAMGVVWGQGTLVTVSS

SEQ ID NO: 4468 - protein, 126 aa, Artificial Sequence
  Description of Artificial Sequence: Synthetic polypeptide
QVQLVESGGGVVQPGRSLRLSCAASRFTFSSYGMHWVRQAPGKGLEWVALIYYDATQKYYADSVKGRFTISRDNSKNALYLQMTSLRADDTAVYYCARDLPYHYHRSASFAPADTWGQGTLVTVSS

SEQ ID NO: 4469 - protein, 120 aa, Artificial Sequence
  Description of Artificial Sequence: Synthetic polypeptide
EVQLLESGGGLVQPGGSLRLSCAASGFTFSSYSMSWVRQAPGKGLEWVATVGYGGTIYYADSVKGRFTISRDNSKNTLYLEMNSLRAEATAVYYCAKANYGGNRFGLDVWGQGTTVTVSS

SEQ ID NO: 4470 - protein, 120 aa, Artificial Sequence
  Description of Artificial Sequence: Synthetic polypeptide
EVQLLESGGGLVQPGGSLRLSCAASGFTFRNYAMAWVRQAPGKGLEWVSAIPARGDKTYYADSVRGRFTISRDISKSALYLQMNSLRVEDTAVYYCAKAHHLYNKNFDYWGQGTLVTVSS

SEQ ID NO: 4471 - protein, 123 aa, Artificial Sequence
  Description of Artificial Sequence: Synthetic polypeptide
EVQLLESGGGSVQPGGSLRLSCAASGFTFSTYVMSWVRQAPGKGLEWVSAISRRGGSTYYADSVKGRFTISRDNSKNTLYLQMNSLRAEDTAVYYCAKDRWLTGRTGGVFDIWGQGTMVTVSS

SEQ ID NO: 4472 - protein, 120 aa, Artificial Sequence
  Description of Artificial Sequence: Synthetic polypeptide
EVQLLESGGGLVQPGGSLRLSCAASGYTFSYYAMSWVRQAPGKGLEWVSTIGDSGSTTHYADSVKGRFTISRDNSKSTLYLQMNSLRAEDTAVYYCAKGLGPVAAIGDYWGQGTLVTVSS

SEQ ID NO: 4473 - protein, 107 aa, Artificial Sequence
  Description of Artificial Sequence: Synthetic polypeptide
DIQMTQSPSSLSASVGDRITITCQASRDITNYLNWYQQKPGKAPKLLIYDASYLETGVPSTFSGSGSGTHFTLTISSLQPDDFATYYCQQYDSVPLTFGGGTKVEIK

SEQ ID NO: 4474 - protein, 115 aa, Artificial Sequence
  Description of Artificial Sequence: Synthetic polypeptide
QVQLVESGGGVVQPGRSLRLSCVASGFTFDNYGMHWVRQAPGKGLEWLAVISYGGDHQFYGDSVKDRFTISRDNSKNTAYLQMHSLRPDDTAVYYCATGVTPDFWGQGTLVTVSS

SEQ ID NO: 4475 - protein, 121 aa, Artificial Sequence
  Description of Artificial Sequence: Synthetic polypeptide
EVQLVESGGGLVNPGGSLRLSCTASGFSFSTYSMNWVRQAPGKGLEWVSLITSSGSYIYYADSVKGRFTISRDDAKNSLYLQMNSLRAEDTAVYYCANMLAAAGSHYFHYWGQGTLVTVSS

SEQ ID NO: 4476 - protein, 114 aa, Artificial Sequence
  Description of Artificial Sequence: Synthetic polypeptide
QVQLVESGGGVVQPGRSLRLSCAASGFTFSNYAMHWVRQAPGKGLEWVAVIWYDGSKKYYGDSVKGRFTISRDNPKNTLYLQMNSLRVEDTAIYYCVPDAFDMWGQGTMVTVSS

SEQ ID NO: 4477 - protein, 123 aa, Artificial Sequence
  Description of Artificial Sequence: Synthetic polypeptide
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARDRIDGSSWSSWFDPWGQGTLVTVSS

SEQ ID NO: 4478 - protein, 60 aa, Artificial Sequence
  Description of Artificial Sequence: Synthetic polypeptide
AQGFTGRFVFSLDTSVNTAYLQISGLKADDTAVYYCARVGIVGVIVFDYWGQGTLVTVSS

SEQ ID NO: 4479 - protein, 126 aa, Artificial Sequence
  Description of Artificial Sequence: Synthetic polypeptide
QVQLVESGGGVVQPGRSLRLSCAASGFTFSSYGMHWVRQAPGKGLEWVAIIYYDSSQRYYADSVKGRFTISRDNSKNALYLQMNSLRAEDTALYYCARDLPFHYHRSASFAPSDTWGQGTLVTVSS

SEQ ID NO: 4480 - protein, 105 aa, Artificial Sequence
  Description of Artificial Sequence: Synthetic polypeptide
EIVLTQSPATLSLSPGERATLSCWASQNVNHYLVWYQQRPGQAPRLLLYDTSVRAAGIPARFIGSGSGTHFTLTISSLEPEDSAVYYCQHRSDWTFGQGTKVEIK

SEQ ID NO: 4481 - protein, 113 aa, Artificial Sequence
  Description of Artificial Sequence: Synthetic polypeptide
DIVMTQSPDSLAVSLGERATINCRSSQTVLFSSNDKNYLAWYQQKPGQPPKLLIYWASVRASGVPDRFSGSGSGTDFSLTINGLQAEDVAVYYCQQSSTAPLTFGGGTKVEIK

SEQ ID NO: 4482 - protein, 109 aa, Artificial Sequence
  Description of Artificial Sequence: Synthetic polypeptide
SYVLTQPPSVSVAPGQTARITCGGNNIGSRGVHWYQQRPGQAPVLVVYDDSDRPSGIPERFSGSNSGDTATLTISRVEVGDEADYYCQVWDNSSDHLVVFGGGTKLTVL

SEQ ID NO: 4483 - protein, 130 aa, Artificial Sequence; identical to SEQ ID NO: 4382
  Description of Artificial Sequence: Synthetic polypeptide

SEQ ID NO: 4484 - protein, 109 aa, Artificial Sequence
  Description of Artificial Sequence: Synthetic polypeptide
EIVLTQSPGTLSLSPGERATLSCRASQDVNNNYLAWYQQKPGQAPRLLIYGASRRATGVPDRFSGRGSGTDFTLTINRLEPEDFAMYFCQQYGGSPPYTFGQGTKLEIK

SEQ ID NO: 4485 - protein, 129 aa, Artificial Sequence
  Description of Artificial Sequence: Synthetic polypeptide
EVQLLESGGGLVQPGGSLRLSCAASGFTFSSYAMSWVRQAPGKGLEWVSAISGGGDRTYSADSVKGRFTISRDNSKNTLYLQINSLRVEDTAVYYCAQGGGGEMTAVTMDGTYYGMDVWGQGTTVTVSS

SEQ ID NO: 4486 - protein, 119 aa, Artificial Sequence
  Description of Artificial Sequence: Synthetic polypeptide
QVQLVESGGGVVQPGMSLRLSCAASGFSFSSHGMHWVRQTPGKGLEWLAVISYDASNKSYADSVKGRFTISRDNSKKTLYLQMDSLRVEDTALYYCANAFSSSASGGYWGQGTLVTVSS

SEQ ID NO: 4487 - protein, 126 aa, Artificial Sequence; identical to SEQ ID NO: 4479
  Description of Artificial Sequence: Synthetic polypeptide

SEQ ID NO: 4488 - protein, 113 aa, Artificial Sequence
  Description of Artificial Sequence: Synthetic polypeptide
DIQMTQSPSSLSASVGDRVTITCRASESIDNYGISFLAWYQQKPGKAPKLLIYAASNRGSGVPSRFSGSGSGTDFTFTISSLQPEDIATYYCQQSKTVPRTFGQGTKLEIKRT

SEQ ID NO: 4489 - protein, 249 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDENWGFDPWGQGTLVTVSSGGGGSGGGGSGGGGSALSYELTQPPSVSVSPGQTATITCSGHALGDKFVSWYQQGSGQSPVLVIYDDTQRPSGIPGRFSGSNSGNTATLTISGTQAMDEADYFCQAWDSSFVFGGGTKVTVLGAAAHHHHHH

SEQ ID NO: 4490 - protein, 262 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCERMGPCTGGSCYDTLGNWGRGTLVTVSSGGGGSGGGGSGGGGSAQSVLTQPPSVSGAPGQRVTISCTGSSSNIGAGYDVHWYQQLPGAAPKLLIRGNGNRPSGVPDRFSVSKSGYSASLAITGLQPADEGVYYCQSYDSSLSGSKVFGQGTKLTVLGAAAHHHHHH

SEQ ID NO: 4491 - protein, 258 aa, Artificial Sequence
  Description of Artificial Sequence: Synthetic polypeptide
QVTLKESGGGLVQPGGSLRLSCAASGFTFSRYVINWVRQAPGKGLEWVSAISVTGGSTAYADSVRGRFTISRDNSKNTLYLQMNSLRAEDTAVYYCTKGQWERGSYYFDYWGRGTLVTVSSGGGGSGGGGSGGGGSAQSVLTQPPSVSGAPGQRVTISCTGSSSNIGDGYDVHWYQQLPGTAPKLLIYGNSHRPSGVPDRFSGSKSDTSASLAITGLQVEDEADYFCHSYDGSVSGWIFGGGTKLTVLGAAAHHHHHH

SEQ ID NO: 4492 - protein, 249 aa, Artificial Sequence; identical to SEQ ID NO: 4489
  Description of Artificial Sequence: Synthetic polypeptide

SEQ ID NO: 4493 - protein, 262 aa, Artificial Sequence
  Description of Artificial Sequence: Synthetic polypeptide
MDYKDDDDKLLPVLTQPPSASGTPGQRVTISCSGSSSNIGSNYVYWYQQLPGTAPKLLIYRNNQRPSGVPDRFSGSKSGTSASLAISGLRSEDEADYYCAAWDDSLNGRVFGGGTKLTVLGEGKSSGSGSESKASEVQLLESGGGLVQPGGSLRLSCAASGFTFSSYAMSWVRQAPGKGLEWVSAISGSGGSTYYADSVKGRFTISRDNSKSTLYLQMNSLRAEDTAIYYCAKGIVGYCSGTSCHAYDFDSWGQGTLVTVSS

SEQ ID NO: 4494 - protein, 254 aa, Artificial Sequence
  Description of Artificial Sequence: Synthetic polypeptide
MDYKDDDDKLLPVLTQPPSASGTPGQRVTISCSGSSSNIGSNYVYWYQQLPGTAPKLLIFRNNQRPSGVPDRFSGSKSGTSASLAISGLRSDDEADYYCVAWDDSLSAWVFGGGTKLTVLGEGKSSGSGSESKASEVQLVQSGGGLVQPGRSLRLSCAASGFPFDDYAMHWVRQAPGKGLEWVSGISWNSGSIGYADSVKGRFTISRDNVKNTLYLQMNNLRVEDTAVYYCAKLAGDIVVIPLWGPGTLVTVSS

SEQ ID NO: 4495 - protein, 119 aa, Artificial Sequence
  Description of Artificial Sequence: Synthetic polypeptide
EEKLEESGGGLVQLGGSMKISCVASGFTLSNYWMDWVRQSPEKGLEWIAEIRLKSNYYSTHYAESVKGRFSISRDDSKGSVSLQMDNLTAEDTGIYFCARNAYWYFDVWGTGTTVTVSS

SEQ ID NO: 4496 - protein, 120 aa, Artificial Sequence
  Description of Artificial Sequence: Synthetic polypeptide
QVQLQQSGAELVRPGTSVKVSCKASGYAFNNYLIEWIKQRPGQGLEWIGVINPGSGGTNHNEKFKVKATLTADKSSSTAYIQLSSLTSDDSAVYFCARSAGTARARFAYWGQGTLVTVSA

SEQ ID NO: 4497 - protein, 120 aa, Artificial Sequence
  Description of Artificial Sequence: Synthetic polypeptide
QIQLVQSGPELKKPGETVKISCKASGYTFTNFGMNWVKQAPGKGLKWMGYINTNTGESIYSEEFKGRFAFSLETSASTAYLQINNLKNEDTATYFCARSRMVTAYGMDYWGQGTSVTVSS

SEQ ID NO: 4498 - protein, 108 aa, Artificial Sequence
  Description of Artificial Sequence: Synthetic polypeptide
DIVMTQSQKFMSTSVGDRVSITCKASQNVGTAVAWYQQRPGQSPKLLIFSASNRYTGVPDRFTGSGSGTDFTLTLSNMQPEDLADYFCQQYSSYPLTFGVGTKLELKR

SEQ ID NO: 4499 - protein, 108 aa, Artificial Sequence
  Description of Artificial Sequence: Synthetic polypeptide
DIQMTQSPSSLSASLGERVSLTCRASQDIGSSLNWLQQEPDGTIKRLIYATSSLDSGVPKRFSGSRSGSDYSLTISSLESEDFVDYYCLQYASFPFTFGSGTKLEIKR

SEQ ID NO: 4500 - protein, 108 aa, Artificial Sequence
  Description of Artificial Sequence: Synthetic polypeptide
DIVMTQSHKFMSTSVGDRVSATCKASQDVGTSVAWYQQKLGQSPKLLIYWTSTRHTGVPDRFTGSGSGTDFTLTISNVQSEDLADYFCQQYNNYPLTFGDGTKLELKR

SEQ ID NO: 4501 - protein, 446 aa, Artificial Sequence
  Description of Artificial Sequence: Synthetic polypeptide
EVQLVESGGGLVQPGGSLRLSCAASGFTFSGTWIHWVRQAPGKGLEWVAAITPADGSTNYADSVKGRFTISADTSKNTAYLQMNSLRAEDTAVYYCATYMFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4502 - protein, 454 aa, Artificial Sequence
  Description of Artificial Sequence: Synthetic polypeptide
EVQLVESGGGLVQPGGSLRLSCAASGFTFSDIAMSWVRQAPGKGLEWVSWIYPSGGNTYYADSVKGRFTISADTSKNTAYLQMNSLRAEDTAVYYCARSYILSQKSATWAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4503 - protein, 115 aa, Artificial Sequence
  Description of Artificial Sequence: Synthetic polypeptide
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKRADAAPTV

SEQ ID NO: 4504 - protein, 123 aa, Artificial Sequence
  Description of Artificial Sequence: Synthetic polypeptide
QVQLQQSGPELVRPGTSVKMSCKASGYTFTNYWIGWAKQRPGHGLEWIGDIYPGGDYTNYNEKFKGKATLTADKSSSTAYMQFSSLTSEDSAIYYCARWGLGYYFDYWGQGITLTVSSAKTTP

SEQ ID NO: 4505 - protein, 121 aa, Artificial Sequence
  Description of Artificial Sequence: Synthetic polypeptide
EVQLQESGAELVKPGASVKLSCTASGFNIKDTYMHWVKQRPEQGLEWIGRIDPANGNTKYDPNFQGKATITSDTSSNTAYLQLSSLTSEDTAVYYCARWGYYGTSGYFDVWGQGTTVTVSS

SEQ ID NO: 4506 - protein, 121 aa, Artificial Sequence
  Description of Artificial Sequence: Synthetic polypeptide
QVQLVESGGGLVQPGRSLRLSCAASGFTFDDYAMHWVRQAPGKGLDWVSAITWNSGHIDYADSVEGRFAVSRDNAKNALYLQMNSLRPEDTAVYYCTKASYLSTSSSLDNWGQGTLVTVSS

SEQ ID NO: 4507 - protein, 121 aa, Artificial Sequence [sequence omitted]

SEQ ID NO: 4508 - protein, 119 aa, Artificial Sequence
  Description of Artificial Sequence: Synthetic polypeptide
QVQLQQSGAELVRSGASVKLSCTASGFNIKDYFMQWVKQRPEQGLEWIGWIDPENGETGYAPKFQGKATMTADTASNTAYLQLSSLTSEDTALYYCNAPSVVAKYFDVWGAGTTVTVSS

SEQ ID NO: 4509 - protein, 118 aa, Artificial Sequence
  Description of Artificial Sequence: Synthetic polypeptide
QVQLQQSGAELVRSGASVKLSCTASGFNIKDYFVQWVKQRPEQGLEWGWIDPENGETGYAPKFQGKATMTADTASNTAYLQLSSLTSEDTALYFCNAPSVVAKYFDVWGAGTTVTVSS

SEQ ID NO: 4510 - protein, 114 aa, Artificial Sequence
  Description of Artificial Sequence: Synthetic polypeptide
QVQLQQSRPELVRPGASVKMSCRASAYTFTTYWMHWVRQRPGQGLEWIGMIDPSNSDTWLNQKFKDKATLNVDRSSNTAYMQLTSLTSEDSAVYYCARTGFDYWGQGTTLTVSS

SEQ ID NO: 4511 - protein, 114 aa, Artificial Sequence
  Description of Artificial Sequence: Synthetic polypeptide
QVHVKQSGPELVRPGASVKMSCKASAYTFTTYWMHWVKQRPGQGLEWIGMIDPYNSETWLNQKFKDKATLNVDRSSNTAYMKLSSLTSEDSAVYYCARTGFDYWGQGTTLTVSS

SEQ ID NO: 4512 - protein, 116 aa, Artificial Sequence
  Description of Artificial Sequence: Synthetic polypeptide
EVQLVESGGGLVQPGGSLRLSCAASGFTFSGTWIHWVRQAPGKGLEWVAAITPADGSTNYADSVKGRFTISADTSKNTAYLQMNSLRAEDTAVYYCATYMFAMDYWGQGTLVTVSS

SEQ ID NO: 4513 - protein, 124 aa, Artificial Sequence
  Description of Artificial Sequence: Synthetic polypeptide
EVQLVESGGGLVQPGGSLRLSCAASGFTFSGNAMSWVRQAPGKGLEWVSWIYPSGGNTYYADSVKGRFTISADTSKNTAYLQMNSLRAEDTAVYYCARSYILSYPSITWAFDYWGQGTLVTVSS

SEQ ID NO: 4514 - protein, 124 aa, Artificial Sequence
  Description of Artificial Sequence: Synthetic polypeptide
EVQLVESGGGLVQPGGSLRLSCAASGFSFSGIAMSWVRQAPGKGLEWVSWIYPSGGNTYYADSVKGRFTISADTSKNTAYLQMNSLRAEDTAVYYCARSYILSYPSITWAFDYWGQGTLVTVSS

SEQ ID NO: 4515 - protein, 124 aa, Artificial Sequence; identical to SEQ ID NO: 4514
  Description of Artificial Sequence: Synthetic polypeptide

SEQ ID NO: 4516 - protein, 124 aa, Artificial Sequence
  Description of Artificial Sequence: Synthetic polypeptide
EVQLVESGGGLVQPGGSLRLSCAASGFSFTGIAMSWVRQAPGKGLEWVSWIYPSGGNTYYADSVKGRFTISADTSKNTAYLQMNSLRAEDTAVYYCARSYILSYPSITWAFDYWGQGTLVTVSS

SEQ ID NO: 4517 - protein, 124 aa, Artificial Sequence
  Description of Artificial Sequence: Synthetic polypeptide
EVQLVESGGGLVQPGGSLRLSCAASGFTFTGKAMSWVRQAPGKGLEWVSWIYPSGGNTYYADSVKGRFTISADTSKNTAYLQMNSLRAEDTAVYYCARSYILSYPSITWAFDYWGQGTLVTVSS

SEQ ID NO: 4518 - protein, 124 aa, Artificial Sequence
  Description of Artificial Sequence: Synthetic polypeptide
EVQLVESGGGLVQPGGSLRLSCAASGFTFSGIAIAWVRQAPGKGLEWVSAIYPSGGNTYYADSVKGRFTISADTSKNTAYLQMNSLRAEDTAVYYCARAYILDNTSITWAFDYWGQGTLVTVSS

SEQ ID NO: 4519 - protein, 124 aa, Artificial Sequence
  Description of Artificial Sequence: Synthetic polypeptide
EVQLVESGGGLVQPGGSLRLSCAASGFTFSDIAMSWVRQAPGKGLEWVSWIYPSGGNTYYADSVKGRFTISADTSKNTAYLQMNSLRAEDTAVYYCARSYILSQKSATWAFDYWGQGTLVTVSS

SEQ ID NO: 4520 - protein, 124 aa, Artificial Sequence
  Description of Artificial Sequence: Synthetic polypeptide
EVQLVESGGGLVQPGGSLRLSCAASGFTFSGNAMSWVRQAPGKGLEWVSWIYPSGGNTYYADSVKGRFTISADTSKNTAYLQMNSLRAEDTAVYYCARSYILDYRFFTWAFDYWGQGTLVTVSS

SEQ ID NO: 4521 - protein, 124 aa, Artificial Sequence; identical to SEQ ID NO: 4513
  Description of Artificial Sequence: Synthetic polypeptide

SEQ ID NO: 4522 - protein, 124 aa, Artificial Sequence
  Description of Artificial Sequence: Synthetic polypeptide
EVQLVESGGGLVQPGGSLRLSCAASGFTFSGNAMSWVRQAPGKGLEWVSWIYPSGGNTYYADSVKGRFTISADTSKNTAYLQMNSLRAEDTAVYYCARSYILSYETSTWAFDYWGQGTLVTVSS

SEQ ID NO: 4523 - protein, 124 aa, Artificial Sequence
  Description of Artificial Sequence: Synthetic polypeptide
EVQLVESGGGLVQPGGSLRLSCAASGFTFSGNAMSWVRQAPGKGLEWVSWIYPSGGNTYYADSVKGRFTISADTSKNTAYLQMNSLRAEDTAVYYCARSYILLHLSATWAFDYWGQGTLVTVSS

SEQ ID NO: 4524 - protein, 214 aa, Artificial Sequence
  Description of Artificial Sequence: Synthetic polypeptide
DIQMTQSPSSLSASVGDRVTITCRASQDVSISLAWYQQKPGKAPKLLIYGASNLESGVPSRFSGSGSGTDFTLTISSLQPEDFATYYCQQHYTLPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4525 - protein, 214 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQSYSTPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4526 - protein, 107 aa, Artificial Sequence
  Description of Artificial Sequence: Synthetic polypeptide
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIK

SEQ ID NO: 4527 - protein, 118 aa, Artificial Sequence
  Description of Artificial Sequence: Synthetic polypeptide
QVQLQQSGPELVRPGTSVKMSCKASGYTFTNYWIGWAKQRPGHGLEWIGDIYPGGDYTNYNEKFKGKATLTADKSSSTAYMQFSSLTSEDSAIYYCARWGLGYYFDYWGQGITLTVSS

SEQ ID NO: 4528 - protein, 113 aa, Artificial Sequence
  Description of Artificial Sequence: Synthetic polypeptide
DIELTQSPASLAVSAGEKVTMSCKSSQSLLSSRTRKNYLAWYQQKPGQSPKLLIYWASTRESGVPDRFTGSGSGTDFTLTISSVQAEDLAVYYCKQSYNLWTFGAGTKLELKR

SEQ ID NO: 4529 - protein, 107 aa, Artificial Sequence [sequence omitted]

SEQ ID NO: 4530 - protein, 107 aa, Artificial Sequence
  Description of Artificial Sequence: Synthetic polypeptide
DIQMTQSPSSLSASIGDRVTITCRASQGIRNYLAWYQQKPGKAPKLLIYAASTLQSGVPSRFSGSGSGTDFTLTISSLQPEDVATYYCQKYNSAPYAFGQGTKVEIK

SEQ ID NO: 4531 - protein, 113 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKR

SEQ ID NO: 4532 - protein, 113 aa, Artificial Sequence
  Description of Artificial Sequence: Synthetic polypeptide
DVVMTQTPLSLPVSLGDQASISCRSSQSLVHSDGNTYLHWYLQKPGQSPKLLIYKVSNRFSGVPDRFSGSGSGTDFTLKISRVEAEDLGVYFCSQSTYVSYTFGGGTKLEIKR

SEQ ID NO: 4533 - protein, 113 aa, Artificial Sequence
  Description of Artificial Sequence: Synthetic polypeptide
DVVLTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKR

SEQ ID NO: 4534 - protein, 113 aa, Artificial Sequence
  Description of Artificial Sequence: Synthetic polypeptide
DVVLTQTPLSLPVSLGDQASISCRSSQSLVHSNGSTYLHWYLQKPGQSPKLLIYKVSNRFSGVPDRFSGSGSGTDFTLKISRVEAEDLGVYFCSQSTHVPYTFGGGTKLEIKR

SEQ ID NO: 4535 - protein, 108 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKR

SEQ ID NO: 4536 - protein, 108 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYWMPPTFGQGTKVEIKR

SEQ ID NO: 4537 - protein, 108 aa, Artificial Sequence
  Description of Artificial Sequence: Synthetic polypeptide
DIQMTQSPSSLSASVGDRVTITCRASQNVDRSLAWYQQKPGKAPKLLIYAASSLESGVPSRFSGSGSGTDFTLTISSLQPEDFATYYCQQHYTLPFTFGQGTKVEIKR

SEQ ID NO: 4538 - protein, 108 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTIPMTFGQGTKVEIKR

SEQ ID NO: 4539 - protein, 108 aa, Artificial Sequence
  Description of Artificial Sequence: Synthetic polypeptide
DIQMTQSPSSLSASVGDRVTITCRASQDVSISLAWYQQKPGKAPKLLIYGASNLESGVPSRFSGSGSGTDFTLTISSLQPEDFATYYCQQHYTLPFTFGQGTKVEIKR

SEQ ID NO: 4540 - protein, 108 aa, Artificial Sequence
  Description of Artificial Sequence: Synthetic polypeptide
DIQMTQSPSSLSASVGDRVTITCRASQDVKKSLAWYQQKPGKAPKLLIYGASNLESGVPSRFSGSGSGTDFTLTISSLQPEDFATYYCQQHYTLPLTFGQGTKVEIKR

SEQ ID NO: 4541 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQSYSTPITFGQGTKVEIKR

SEQ ID NO: 4542 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQAFSTPITFGQGTKVEIKR

SEQ ID NO: 4543 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQSFLSPITFGQGTKVEIKR

SEQ ID NO: 4544 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQAYLTPVTFGQGTKVEIKR

SEQ ID NO: 4545 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQAFISPITFGQGTKVEIKR

SEQ ID NO: 4546 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQGFSTPITFGQGTKVEIKR

SEQ ID NO: 4547 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSLASGVPSRFSGSGSGTDFTLTISSLQPEDFATYYCQQAFLSPITFGQGTKVEIKR

SEQ ID NO: 4548 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSLDSGVPSRFSGSGSGTDFTLTISSLQPEDFATYYCQQSYSTPITFGQGTKVEIKR

SEQ ID NO: 4549 - protein, 108 aa, Artificial Sequence
  Description of Artificial Sequence: Synthetic polypeptide
DIQMTQSPSSLSASVGDRVTITCRASQSISSYLAWYQQKPGKAPKLLIYGASSRASGVPSRFSGSGSGTDFTLTISSLQPEDFATYYCQQAYLSPITFGQGTKVEIKR

SEQ ID NO: 4550 - protein, 250 aa, Artificial Sequence
  Description of Artificial Sequence: Synthetic polypeptide
QVQLQQSGAEVKNPGSSVKVSCKPSRDTLSGDNFSSSVFSWVRQAPGQGLEWMGGIIPIFGVANYAQKFQPRVTISADMSTNTAYMELSSLRSEDTAVYYCASTWELRNAFDIWGKGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4551 - protein, 251 aa, Artificial Sequence
  Description of Artificial Sequence: Synthetic polypeptide
EVQLVQSGAEVKKPGASVRVSCKASGYSFTNFYMHWLRQAPGRGPEWMGIIDPSNNYTYYAQKRVTVTRDTSTSTVYMELSSLRSEDTAIYYCARPVYYYDSSGYYYGLNAFDISWGRGTMVTVSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4552 - protein, 242 aa, Artificial Sequence
  Description of Artificial Sequence: Synthetic polypeptide
QMQLQESGAEVKKPGSSVKVSCKASGDTFRSYIISWVRQAPGQGLEWMGGIIPMFGTTNYAQQFQGKVTITADDSTSTSYMELRSLRSDDTAVYYCARGTNYMDVWGQGTTVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4553 - protein, 248 aa, Artificial Sequence
  Description of Artificial Sequence: Synthetic polypeptide
QVQLQQSGAEVKKPGSSVKVSCKASGGTFSSYAISWVRQAPGQGLEWMGGSIPKFRTANYAKKFQGRVTITADESTSTAYMELSSLRSDDTAVYYCARGSAYNLRNAFDIWGQGTTVTVSSGGGGSGGGGSGGGGSAQSVVTQPPSVSAAPGQRVTISCSGSSSNIANNYVSWYQQLPGTAPKLLIYDNNKRPSGIPDRFSGSKSGTSATLGITGLQTGDEADYYCGTWDSSLSAYVFGTGTKVTVLG

SEQ ID NO: 4554 - protein, 244 aa, Artificial Sequence
  Description of Artificial Sequence: Synthetic polypeptide
QVQLQQSGGGVVQPGRSLRLSCAASGFTFDDYAMHWVRQAPGKGLEWVSGISWNSGSIGYADSVKGRFTISRDNAKNSLYLQMNSLRAEDTALYYCAKTGGGNSLDYWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4555 - protein, 247 aa, Artificial Sequence
  Description of Artificial Sequence: Synthetic polypeptide
QVQLLQSAPEVKKPGSSVRVSCKTSGGTFSSQLINWVRQPPGQGPEWMGGIIPIFGTANYAQKFQGRVTITADESTSTAYMELSSLRSEDTAVYYCARDLTAGRFDAFHIWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4556 - protein, 248 aa, Artificial Sequence
  Description of Artificial Sequence: Synthetic polypeptide
QVQLQQSGAEVKKPGSSVKVSCKASGGTFSSYAISWVRQAPGQGLEWMGGSIPKFRTANYAKKFQGRVTITADESTSTAYMELSSLRSDDTAVYYCARGSTYNLRNAFDIWGKGTLVTVSSGGGGSGGGGSGGGGSAQSVVTQPPSASGTPGQRVTISCSGGSSNIGRNTVNWYQQVPGTAPKLLIYTNNQRPSGVPDRFSGSKSGTSASLAISGLQSEDEADYYCAAWDDSLNDVEFGGGTKLTVLG

SEQ ID NO: 4557 - protein, 243 aa, Artificial Sequence
  Description of Artificial Sequence: Synthetic polypeptide
QVQLQESGGGLEQPGRSLRLSCTASGFTFDDYPMHWVRQAPGKGLEWVSGISGNSDRIAYADSVKGRFTISRDNSKNTLWLQMNSLRAEDTAIYYCARAARNWFDPWGQGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4558 - protein, 255 aa, Artificial Sequence
  Description of Artificial Sequence: Synthetic polypeptide
QVQLVQSGAEVKKPGFSVKVSCKASGGSFSNYVISWLRQAPGQGLEWMGGIMPIFGNANYAQKFQDRVTITADKSTSTAYMELSSLRSDDTAVYYCARDQIVVDPVTKGAYYSGLDVWGRGTMVTVSSGGGGSGGGGSGGGGSAQSVLTQPPSASGTPGQRVTISCSGGSSNIGANAITWFQQLPGTAPKLLIYHNNQRPSGVPDRFSGSKSGTSGSLAISGLQSEDEADYYCAVWDNSLNAMLFGGGTKLTVLG

SEQ ID NO: 4559 - protein, 245 aa, Artificial Sequence
  Description of Artificial Sequence: Synthetic polypeptide
EVQLVQSGAEVKRPGASVKISCRTSGYTFTSYYIHWVRQAPGQGLEWLAIINPTAGNTYYTQDFQDRVTVTRDTSTSTVYMELRGLNSEDTAVYYCASPYGVRNAFDVWGQGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4560 - protein, 248 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARQGSGSYPPPAFDSWGRGTMVTVSSGGGGSGGGGSGGGGSAQAVVIQEPSLTVSPGGTVTLTCAFNSGQVTSGFYPNWFQQKPGQPPRSLIYNTDNKHSWTPARFSGSLLGGKAALTLSGVQPDDEADYYCLLYYDRSLVFGGGTKLTVLG

SEQ ID NO: 4561 - protein, 243 aa, Artificial Sequence
  Description of Artificial Sequence: Synthetic polypeptide
QVQLVQSGGGLVQPGRSLRLSCAASGFTFDDYAMHWVRQAPGKGLEWVSGISWNSASIGYADSVKGRFTISRDNAKNSLYLQMNSLRGEDTALYYCAKGARDALDIWGKGTLLTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4562 - protein, 251 aa, Artificial Sequence
  Description of Artificial Sequence: Synthetic polypeptide
QVQLQQSGPGLVKPSQTLSLTCAISGDSVSSNTAAWSWIRQSPSRGLEWLGRTYYSRSKWYKDYAVSVKSRITINPDTSKNQFSLQLDSVTPEDTAVYYCTREGYYDYSGVVDYWGQGTTVIVSSGGGGSGGGGSGGGGSQSVLTQPPSASGSPGQSVTISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 4563 - protein, 245 aa, Artificial Sequence
  Description of Artificial Sequence: Synthetic polypeptide
QVQLQQSGAEVKKPGSSVKVSCKASGDTFSSNTISWVRQAPGQGLEWMGGIIPIIGTPHYAQKFQGRVTITADRSTSTAYMELTNLRSEDTAVYFCARNRVGTSSFDFWGQGTMVTVSSGGGGSGGGGSGGGGSALPVLTQPPSASGTPGQRVTISCSGSSSNIGSNTVNWYQQLPGTAPKLFIYSNNQRPSGVPDRFSGSKSGTSASLAISGLQSEDEADYYCSSWDDSLNLIFGGGTKVTVLG

SEQ ID NO: 4564 - protein, 245 aa, Artificial Sequence
  Description of Artificial Sequence: Synthetic polypeptide
QVQLVQSGAEVKKPGTSVKVSCKAAGDTFRSYIISWVRQAPGQGLEWVGGIIPMFGTSNYAQKFQGRVTITADDSTSTAYMELSSLRSEDTAVYYCARTAQGGSYYNYWGQGTPVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDGLSEFLFGTGTKLTVLG

SEQ ID NO: 4565 - protein, 247 aa, Artificial Sequence
  Description of Artificial Sequence: Synthetic polypeptide
QVQLQQSGAEVKKPGASVKVSCKASGYTFTGYYMHWVRQAPGQRLEWMGGILPFFGTTSYAQNFHGRLTITADESTRTAYMELSSLKSEDTAVYYCARDESADPKNAFDIWGRGTMVTVSSGGGGSGGGGSGGGGSQSVLTQPPPVSAAPGQKVTISCSGSTSNIGNNYVSWYQQRPGKAPKLMIYDVSKRPSGVPDRFSGSKSGNSASLDISGLQSEDEADYYCAAWDDSLSEFLFGTGTKLTVLG

SEQ ID NO: 4566 - protein, 246 aa, Artificial Sequence
  Description of Artificial Sequence: Synthetic polypeptide
QVQLQQSGNEVKKPGSSVKISCKASGAPFNSYVISWVRQAPGQGLEWVGGVVPIFGTAHYAHQFQGRVTIIADKSTSTVYMELRGLTSDDTAEYFCARQGPYGKLDDWGQGTMVTVSSGGGGSGGGGSGGGGSALSYELTQPPSASGTPGQRVTISCSGSSSNIGSNYVYWYQQFPGTAPKLLMYRNNQRPSGVPDRFSGSKFGTSASLAISGLRSEDEADYYCAAWDDSLTGRVFGGGTKVTVLG

SEQ ID NO: 4567 - protein, 248 aa, Artificial Sequence
  Description of Artificial Sequence: Synthetic polypeptide
QVQLQQSGAEVKKPGSSVNVSCKASGGTFDTFGISWVRQAPGKGLEWMGVIAHDGSISYYADSVKGRFTFSRDNSKNTVSLQMNSPRPEDTAVYYCAKGEYDSSGYNAFDIWGKGTLVTVSSGGGGSGGGGSGGGGSQSVLTQPPSVSAAPGQKVTVSCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4568 - protein, 242 aa, Artificial Sequence
  Description of Artificial Sequence: Synthetic polypeptide
QVQLVQSGAEVKKPGSSVRISCKASGGSFRTYVVSWVRQAPGQGLEWMGGIIPVYGTPNYAQKFQGRVTITADEPTRTTYMELSSLRSEDTGVYYCARNGGGLDYWGQGTMVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 4569 - protein, 263 aa, Artificial Sequence
  Description of Artificial Sequence: Synthetic polypeptide
SLALQLLSTQDLTMGWSCIILFLVATATGVHSQTSSPSADGGGGSGGGGSDIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4570 - protein, 259 aa, Artificial Sequence
  Description of Artificial Sequence: Synthetic polypeptide
STQDLTMGWSCIILFLVATATGVHSQSLLPAIVELGGGGSGGGGSDIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4571 - protein, 107 aa, Artificial Sequence
  Description of Artificial Sequence: Synthetic polypeptide
DIVMTQTPSSLSASVGDRVTITCRASQDISKFLNWYQQKPGKAPKLLIYHTSRLHSGVPSRFSGSGSGTDFTLTISSLQPEDFATYYCQQGNTLPYTFGPGTKVDIK

SEQ ID NO: 4572 - protein, 107 aa, Artificial Sequence
  Description of Artificial Sequence: Synthetic polypeptide
DIVMTQTPSSLSASVGDRVTITCRASQDISKYLNWYQQKPGKAIKLLIYHTSRLHSGVPSRFSGSGSGTDFTLTISSLQPEDFATYYCQQGNTLPYTFGPGTKVDIK

SEQ ID NO: 4573 - protein, 107 aa, Artificial Sequence
  Description of Artificial Sequence: Synthetic polypeptide
DIVMTQTPSSLSASVGDRVTITCRASQDISKYLNWYQQKPGKALKLLIYHTSRLHSGVPSRFSGSGSGTDFTLTISSLQPEDFATYYCQQGNTLPYTFGPGTKVDIK

SEQ ID NO: 4574 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDFTLTISSLQPEDFATYYCQQGATLPYTFGPGTKVDIK

SEQ ID NO: 4575 - protein, 449 aa, Artificial Sequence
  Description of Artificial Sequence: Synthetic polypeptide
QVQLVQSGAEVKKPGSSVKVSCKASGGTFSSYGISWVRQAPGQGLEWMGGIIPIFGTANYAQKFQGRVTITADESTSTAYMELSSLRSEDTAVYYCARYDGIYGELDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4576 - protein, 216 aa, Artificial Sequence
  Description of Artificial Sequence: Synthetic polypeptide
EIVLTQSPATLSLSPGERATLSCRASQSVSDAYLAWYQQKPGQAPRLLIYDASSRATGVPARFSGSGSGTDFTLTISSLEPEDFAVYYCHQYIQLHSFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4577 - protein, 750 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4578 - protein, 750 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGQRHNNSSLNTGTQMAGHSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4579 - protein, 747 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4580 - protein, 740 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGSSLNTGTQPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4581 - protein, 747 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGGGGGSGGGGSGGGGSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4582 - protein, 740 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGSSLNTGTQPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4583 - protein, 743 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGEVQIPLTESYSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4584 - protein, 743 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSQEDPEVQFNWYVDGVEVHNAKTKPREEQFASTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGEVQIPLTESYSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4585 - protein, 795 aa, Artificial Sequence
  Description of Artificial Sequence: Synthetic polypeptide
QVQVQESGPGLVAPSQTLSITCTVSGFSLTTSGVSWVRQPPGKGLEWLGVIWGDGSTNYHPSLKSRLSIKKDHSKSQVFLKLNSLTAADTATYYCAKGGYSLAHWGQGTLVTVSSGGGGSGGGGSGGGGSGGGGSGGGGSQVQVQESGPGLVAPSQTLSITCTVSGFSLTTSGVSWVRQPPGKGLEWLGVIWGDGSTNYHPSLKSRLSIKKDHSKSQVFLKLNSLTAADTATYYCAKGGYSLAHWGQGTLVTVSSDFTLTISSLEPEDFAVYYCQHHSDNPWTFGQGTKVEIKSSSEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTGTQMAGHSPNSQVQLVESGGGVVQPGRSLRLSCKASGYTFTRSTMHWVRQAPGQGLEWIGYINPSSAYTNYNQKFKDRFTISADKSKSTAFLQMDSLRPEDTGVYFCARPQVHYDYNGFPYWGQGTPVTVSSGGGGSGGGGSGGGGSAQDIQMTQSPSSLSASVGDRVTMTCSASSSVSYMNWYQQKPGKAPKRWIYDSSKLASGVPARFSGSGSGTDYTLTISSLQPEDFATYYCQQWSRNPPTFGGGTKLQITSSS

SEQ ID NO: 4586 - protein, 210 aa, Artificial Sequence
  Description of Artificial Sequence: Synthetic polypeptide
GGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLEVKGFYPSDIAVEWESNGQPENNYKTTPPVLDSDGSFFLYSKRLTVDKSRWQQGNVFSCSVMHEALHNHYTQKSLSL

SEQ ID NO: 4587 - protein, 211 aa, Artificial Sequence [sequence omitted]

SEQ ID NO: 4588 - protein, 230 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKM

SEQ ID NO: 4589 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4590 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4591 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4592 - protein, 486 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4593 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4594 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4595 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4596 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4597 - protein, 491 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4598 - protein, 491 aa, Artificial Sequence; identical to SEQ ID NO: 4597
  Description of Artificial Sequence: Synthetic polypeptide

SEQ ID NO: 4599 - protein, 491 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4600 - protein, 486 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 4601 - protein, 114 aa, Artificial Sequence
  Description of Artificial Sequence: Synthetic polypeptide
DIVMTQTPASLAVSLGQRATISCKASQSVDYNGDSYLNWYQQRPGQPPKLLIYDASNLVSGVPDRFSGSGSGTDFTLNIHPVEKEDAATYYCQQSTEDPYTFGGGTKLEIKRAD

SEQ ID NO: 4602 - protein, 124 aa, Artificial Sequence
  Description of Artificial Sequence: Synthetic polypeptide
EVQLQESGPELVKPGASVKMSCKASGYTFTSYVMHWVKQKPGQGLEWIGYINPYNDGTDYNEKFKGKATLTSDKSSSTAYMALSSLTSEDSAVYYCARGTYYYGSSYYYPFDYWGQGTTLTVSS

SEQ ID NO: 4603 - protein, 110 aa, Artificial Sequence
  Description of Artificial Sequence: Synthetic polypeptide
RNDAQPAVYLFQPSPDQLHTGSASVVCLLNSFYPKDINVKWKVDGVIQDTGIQESVTEQDKDSTYSLSSTLTMSSTEYLSHELYSCEITHKSLPSTLIKSFQRSECQRVD

SEQ ID NO: 4604 - protein, 335 aa, Artificial Sequence
  Description of Artificial Sequence: Synthetic polypeptide
ASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 4605 - protein, 109 aa, Artificial Sequence
  Description of Artificial Sequence: Synthetic polypeptide
RTDAQPAVYLFQPSPDQLHTGASVVCLLNSFYPKDINVKWKVDGVIQDTGIQESVTEQDKDSTYSLSSTLTMSSTEYLSHELYSCEITHKSLPSTLIKSFQRSECQRVD

SEQ ID NO: 4606 - protein, 110 aa, Artificial Sequence
  Description of Artificial Sequence: Synthetic polypeptide
RNDAQPAVYLFQPSPDQLHTGSASVVCLLSSFYPKDINVKWKVDGVIQDTGIQESVTEQDKDSTYSLSSTLTMSSTEYLSHELYSCEITHKSLPSTLIKSFQRSECQRVD

SEQ ID NO: 4607 - protein, 110 aa, Artificial Sequence
  Description of Artificial Sequence: Synthetic polypeptide
RTDAQPAVYLFQPSPDQLHTGSASVVCLLSSFYPKDINVKWKVDGVIQDTGIQESVTEQDKDSTYSLSSTLTMSSTEYLSHELYSCEITHKSLPSTLIKSFQRSECQRVD

SEQ ID NO: 4608 - protein, 335 aa, Artificial Sequence
  Description of Artificial Sequence: Synthetic polypeptide
ASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEPAGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 4609 - protein, 335 aa, Artificial Sequence
  Description of Artificial Sequence: Synthetic polypeptide
ASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFAGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 4610 - protein, 335 aa, Artificial Sequence
  Description of Artificial Sequence: Synthetic polypeptide
ASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEAAGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 4611 - protein, 180 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGQVQLQQSGPELVKPGASLKLSCTASGFNIKDTYIHWVKQRPEQGLEWIGRIYPTNGYTRYDP

SEQ ID NO: 4612 - protein, 92 aa, Artificial Sequence
  Description of Artificial Sequence: Synthetic polypeptide
KFQDKATITADTSSNTAYLQVSRLTSEDTAVYYCSRWGGDGFYAMDYWGQGASVTVSSGGCGGGKVAALKEKVAALKEKVAALKEKVAALKE

SEQ ID NO: 4613 - protein, 276 aa, Artificial Sequence
  Description of Artificial Sequence: Synthetic polypeptide
DIVMTQSHKFMSTSVGDRVSITCKASQDVNTAVAWYQQKPGHSPKLLIYSASFRYTGVPDRFTGNRSGTDFTFTISSVQAADLAVYYCQQHYTTPPTFGGGTKLEIKRAGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGEVAALEKEVAALEKEVAALEKEVAALEK

SEQ ID NO: 4614 - protein, 278 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGEVAALEKEVAALEKEVAALEKEVAALEK

SEQ ID NO: 4615 - protein, 276 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGCGGGKVAALKEKVAALKEKVAALKEKVAALKE

SEQ ID NO: 4616 - protein, 271 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSSGGCGGGEVAALEKEVAALEKEVAALEKEVAALEK

SEQ ID NO: 4617 - protein, 274 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGKVAALKEKVAALKEKVAALKEKVAALKE

SEQ ID NO: 4618 - protein, 275 aa, Artificial Sequence
  Description of Artificial Sequence: Synthetic polypeptide
DIQMTQSPSSLSASVGDRVTITCRASQDISNYLNWYQQKPGKAPKLLIYYTSRLHSGVPSRFSGSGSGTDFTLTISSLQPEDIATYYCQQGNTLPPTFGGGTKLEIKGGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGEVAALEKEVAALEKEVAALEKEVAALEK

SEQ ID NO: 4619 - protein, 272 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGQVQLVQSGAEVKKPGASVKVSCKASGYTFTSYWMQWVRQAPGQGLEWMGTIYPGDGDTRYTQKFKGRVTITADKSTSTAYMELSSLRSEDTAVYYCARRGIPRLWYFDVWGQGTTVTVSSGGCGGGKVAALKEKVAALKEKVAALKEKVAALKE

SEQ ID NO: 4620 - protein, 275 aa, Artificial Sequence
  Description of Artificial Sequence: Synthetic polypeptide
DIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIKGGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGEVAALEKEVAALEKEVAALEKEVAALEK

SEQ ID NO: 4621 - protein, 274 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGEVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSGGCGGGKVAALKEKVAALKEKVAALKEKVAALKE

SEQ ID NO: 4622 - protein, 279 aa, Artificial Sequence
  Description of Artificial Sequence: Synthetic polypeptide
DVVMTQTPFSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGEVAALEKEVAALEKEVAALEKEVAALEK

SEQ ID NO: 4623 - protein, 270 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSSGGCGGGKVAALKEKVAALKEKVAALKEKVAALKE

SEQ ID NO: 4624 - protein, 274 aa, Artificial Sequence
  Description of Artificial Sequence: Synthetic polypeptide
QIVLTQSPAIMSASPGERVTMTCSARSSISFMYWYQQKPGSSPRLLIYDTSNLASGVPVRFSGSGSGTSYSLTISRMEAEDAATYYCQQWSSYPLTFGSGTKLELKRGGGSGGGGEVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSSGGCGGGKVAALKEKVAALKEKVAALKEKVAALKE

SEQ ID NO: 4625 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTCFTLTISSLQPEDFATYYCLQNVANPATFSQGTKVEIKR

SEQ ID NO: 4626 - protein, 224 aa, Artificial Sequence
  Description of Artificial Sequence: Synthetic polypeptide
  MOD_RES (178)..(178): Any amino acid
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVXQSSGLYSLSSVVTVPSSSLGTQTYICNVNHKPSNTKVDKKVEPKSC

SEQ ID NO: 4627 - protein, 221 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKS

SEQ ID NO: 4628 - protein, 221 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVSQSSGLYSLSSVVTVPSSSLGTQTYICNVNHKPSNTKVDKRVEPKS

SEQ ID NO: 4629 - protein, 221 aa, Artificial Sequence
  Description of Artificial Sequence: Synthetic polypeptide
  MOD_RES (176)..(176): Any amino acid
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVXQSSGLYSLSSVVTVPSSSLGTQTYICNVNHKPSNTKVDKRVEPKS

SEQ ID NO: 4630 - protein, 224 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVSQSSGLYSLSSVVTVPSSSLGTQTYICNVNHKPSNTKVDKKVEPKSC

SEQ ID NO: 4631 - protein, 227 aa, Artificial Sequence
  Description of Artificial Sequence: Synthetic polypeptide
DKTHTCPPCPAPELKGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4632 - protein, 227 aa, Artificial Sequence
  Description of Artificial Sequence: Synthetic polypeptide
DKTHTCPPCPAPELLGGPSVFLFPPKPKDTLMKSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4633 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGKEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4634 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVKHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4635 - protein, 227 aa, Artificial Sequence
  Description of Artificial Sequence: Synthetic polypeptide
  MOD_RES (15)..(15): Any amino acid
DKTHTCPPCPAPELXGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4636 - protein, 227 aa, Artificial Sequence
  Description of Artificial Sequence: Synthetic polypeptide
  MOD_RES (33)..(33): Any amino acid
DKTHTCPPCPAPELLGGPSVFLFPPKPKDTLMXSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4637 - protein, 227 aa, Artificial Sequence
  Description of Artificial Sequence: Synthetic polypeptide
  MOD_RES (62)..(62): Any amino acid
DKTHTCPPCPAPELLGGPSVFLFPPKPKDTLMISRTPEVTCVVVDVSHEDPEVKFNWYVDGXEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4638 - protein, 227 aa, Artificial Sequence
  Description of Artificial Sequence: Synthetic polypeptide
  MOD_RES (89)..(89): Any amino acid
DKTHTCPPCPAPELLGGPSVFLFPPKPKDTLMISRTPEVTCVVVDVSHEDPEVKFNWYVDGVEVHNAKTKPREEQYNSTYRVVSVLTVXHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4639 - protein, 231 aa, Artificial Sequence
  Description of Artificial Sequence: Synthetic polypeptide
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4640 - protein, 231 aa, Artificial Sequence
  Description of Artificial Sequence: Synthetic polypeptide
PKSCDKTHTCPPCPAPELKGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4641 - protein, 231 aa, Artificial Sequence
  Description of Artificial Sequence: Synthetic polypeptide
PKSCDKTHTCPPCPAPELLGGPSVFLFPPKPKDTLMKSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4642 - protein, 231 aa, Artificial Sequence
  Description of Artificial Sequence: Synthetic polypeptide
PKSCDKTHTCPPCPAPELLGGPSVFLFPPKPKDTLMISRTPEVTCVVVDVSHEDPEVKFNWYVDGKEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4643 - protein, 231 aa, Artificial Sequence
  Description of Artificial Sequence: Synthetic polypeptide
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVKHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4644 - protein, 231 aa, Artificial Sequence
  Description of Artificial Sequence: Synthetic polypeptide
  MOD_RES (19)..(19): Any amino acid
PKSCDKTHTCPPCPAPELXGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4645 - protein, 231 aa, Artificial Sequence
  Description of Artificial Sequence: Synthetic polypeptide
  MOD_RES (37)..(37): Any amino acid
PKSCDKTHTCPPCPAPELLGGPSVFLFPPKPKDTLMXSRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4646 - protein, 231 aa, Artificial Sequence
  Description of Artificial Sequence: Synthetic polypeptide
  MOD_RES (66)..(66): Any amino acid
PKSCDKTHTCPPCPAPELLGGPSVFLFPPKPKDTLMISRTPEVTCVVVDVSHEDPEVKFNWYVDGXEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4647 - protein, 231 aa, Artificial Sequence
  Description of Artificial Sequence: Synthetic polypeptide
  MOD_RES (93)..(93): Any amino acid
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVXHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4648 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4649 - protein, 218 aa, Artificial Sequence
  Description of Artificial Sequence: Synthetic polypeptide
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4650 - protein, 503 aa, Artificial Sequence
  Description of Artificial Sequence: Synthetic polypeptide
MEAPAQLLFLLLLWLPDTTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4651 - protein, 542 aa, Artificial Sequence
  Description of Artificial Sequence: Synthetic polypeptide
MSPILGYWKIKGLVQPTRLLLEYLEEKYEEHLYERDEGDKWRKFELGLEFPNLPYYIDGDVKLTQSMAIIRYIADKHNMLGGCPKERAEISMLEGAVLDIRYGVSRIAYSKDFETLKVDFLSKLPEMLKMFEDRLCHKTYLNGDHVTHPDFMLYDALDVVLYMDPMCLDAFPKLVCFKKRIEAIPQIDKYLKSSKYIAWPLQGWQATFGGGDHPPKSDLVPRGSLSQEGINILTHLPKGSAEAELMSWPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLS

SEQ ID NO: 4652 - protein, 351 aa, Artificial Sequence
  Description of Artificial Sequence: Synthetic polypeptide
MGSHHHHHHGMASMTGGQQMGRTLYDDDDKDRWGSQEGINLILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLWLVENYQLDNGSFKENSQYQPIKLQGTLPVEARENSLYLTAFTVIGIRKAFDICPLVKIDTALIKADNFLLENTLPAQSTFLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLS

SEQ ID NO: 4653 - protein, 499 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4654 - protein, 499 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4655 - protein, 499 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4656 - protein, 505 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4657 - protein, 234 aa, Artificial Sequence
  Description of Artificial Sequence: Synthetic polypeptide
DQEPKSSDKTHTSPPSPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4658 - protein, 240 aa, Artificial Sequence
  Description of Artificial Sequence: Synthetic polypeptide
DQPVPSTPPTPSPSTPPTPSPSCAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4659 - protein, 482 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 4660 - protein, 422 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSDPENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKLE

SEQ ID NO: 4661 - protein, 383 aa, Artificial Sequence
  Description of Artificial Sequence: Synthetic polypeptide
MGVLLTQRTLLSLVLALLFPSMASMAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4662 - protein, 133 aa, Artificial Sequence
  Description of Artificial Sequence: Synthetic polypeptide
AMRSCPEEQYDHLLRDCISCEGAPSVFLFPHNAKTKPREETISKAKGQPRGQPENNYKTTHYTQKSLSLSWDPLLGTCMSASICGQHPKQPKPKDTLMISQYNSTYRVVSEPQVYTLPPSPPVLDSDGSFPGK

SEQ ID NO: 4663 - protein, 421 aa, Artificial Sequence
  Description of Artificial Sequence: Synthetic polypeptide
AVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4664 - protein, 357 aa, Artificial Sequence
  Description of Artificial Sequence: Synthetic polypeptide
MHVAQPAVVLASSRGIASFVCEYASPGKYTEVRVTVLRQADSQVTEVCAATYMMGNELTFLDDSICTGTSSGNQVNLTIQGLRAMDTGLYICKVELMYPPPYYEGIGNGTQIYVIDPEPCPDSDQEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4665 - protein, 290 aa, Artificial Sequence
  Description of Artificial Sequence: Synthetic polypeptide
GCKWDLLIKQWVCDPLGSGSATGGSGSTASSGSGSATHMLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4666 - protein, 328 aa, Artificial Sequence
  Description of Artificial Sequence: Synthetic polypeptide
DPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLATGGGTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPVPIEKTISKAKGQPREPQVYTLPPSREEMTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 4667 - protein, 408 aa, Artificial Sequence
  Description of Artificial Sequence: Synthetic polypeptide
SVFDSKFNGIHVYSEIGELETVLVHEPGREIDYITPARLDELLFSAILESHDARKEHQSFVKIMKDRGINVVELTDLVAETYDLASKAAKEEFIETFLEETVPVLTEANKEAVRAFLLSKPTHEMVEFMMSGITKYELGVESENELIVDPMPNLYFTRDPFASVGNGVTIHFMRYIVRRRETLFARFVFRNHPKLVKTPWYYDPAMKMSIEGGDVFIYNNETLVVGVSERTDLDTITLLAKNIKANKEVEFKRIVAINVPKWTNLMHLDTWLTMLDKNKFLYSPIANDVFKFWDYDLVNGGAEPQPQLNGLPLDKLLASIINKEPVLIPIGGAGATEMEIARETNFDGTNYLAIKPGLVIGYDRNEKTNAALKAAGITVLPFHGNQLSLGMGNARCMSMPLSRKDVKW

SEQ ID NO: 4668 - protein, 106 aa, Artificial Sequence
  Description of Artificial Sequence: Synthetic polypeptide
MDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFN

SEQ ID NO: 4669 - protein, 880 aa, Artificial Sequence
  Description of Artificial Sequence: Synthetic polypeptide
SERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVEKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNSGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4670 - protein, 279 aa, Artificial Sequence
  Description of Artificial Sequence: Synthetic polypeptide
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCERK

SEQ ID NO: 4671 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHFYYGGSYAMDYWGQGTLVTVSS

SEQ ID NO: 4672 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYFYGGSYAMDYWGQGTLVTVSS

SEQ ID NO: 4673 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYFGGSYAMDYWGQGTLVTVSS

SEQ ID NO: 4674 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSFAMDYWGQGTLVTVSS

SEQ ID NO: 4675 - protein, 330 aa, Artificial Sequence [sequence omitted]

SEQ ID NO: 4676 - protein, 443 aa, Artificial Sequence
  Description of Artificial Sequence: Synthetic polypeptide
QVQLQESGPGLVKPSQTLSLTCTVSGGSISSGEYYWNWIRQHPGKGLEWIGYIYYSGSTYYNPSLKSRVTISVDTSKNQFSLKLSSVTAADTAVYYCARESVAGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 4677 - protein, 466 aa, Artificial Sequence
  Description of Artificial Sequence: Synthetic polypeptide
MACPGFLWALVISTCLEFSMAEVQLVESGGGLVQPGGSLRLSCAASGFTFSSYAMSWVRQAPGKGLEWVSAISGSGGSTYYADSVKGRFTISRDNSKDTLYLQMSSLKTEDTAVYYCARGSLLQFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4678 - protein, 450 aa, Artificial Sequence
  Description of Artificial Sequence: Synthetic polypeptide
QVQLVQSGAEVKKPGASVKVSCKASGFNIKDTYIHWVRQAPGQRLEWMGRIDPANGYTKYDPKFQGRVTITADTSASTAYMELSSLRSEDTAVYYCAREGYYGNYGVYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4679 - protein, 452 aa, Artificial Sequence
  Description of Artificial Sequence: Synthetic polypeptide
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4680 - protein, 117 aa, Artificial Sequence
  Description of Artificial Sequence: Synthetic polypeptide
VKLQESGAELVKPGASVKLSCKASGYTFTSYWMHWVKQRPGRGLEWIGRIGPNSGGTKYNEKFKSKATLTVDKPSSTAYMQLSSLTSEDSAVYYCARRMVKGCYGLLGPRDHGHRLL

SEQ ID NO: 4681 - protein, 117 aa, Artificial Sequence
  Description of Artificial Sequence: Synthetic polypeptide
VKLQESGPELVKPGASVKISCKASGYTFTDYYMNWVKQSHGKSLEWIGDINPNNGGTSYNQKFKGKATLTVDKSSSTAYMELRSLTSEDSAVYYCARYDYAWYFDVWGQGTTVTVSS

SEQ ID NO: 4682 - protein, 117 aa, Artificial Sequence
  Description of Artificial Sequence: Synthetic polypeptide
VKLQESGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTVTVS

SEQ ID NO: 4683 - protein, 118 aa, Artificial Sequence
  Description of Artificial Sequence: Synthetic polypeptide
QVQLQQSGAELARPGASVKLSCKASGYTFTNYGLSWVKQRTGQGLEWIGENHPGSGIIYHNEKFRGKATLTADKSSSTAYVQLSSLTSEDSAVYFCARSSGTRGFAYWGQGTLVTVSA

SEQ ID NO: 4684 - protein, 452 aa, Artificial Sequence
  Description of Artificial Sequence: Synthetic polypeptide
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 4685 - protein, 449 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHDPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4686 - protein, 111 aa, Artificial Sequence
  Description of Artificial Sequence: Synthetic polypeptide
EVQLVQSGAEVKKPGESLRISCKGSGYIFTNYPIHWIRQPPGKGLEWIGFIDPGGGYDEPDERFRDRFVFSLDTSVSTAYLQICSLKAEDTAVYYCARRGGGYYLDYWGQG

SEQ ID NO: 4687 - protein, 111 aa, Artificial Sequence; identical to SEQ ID NO: 4686
  Description of Artificial Sequence: Synthetic polypeptide

SEQ ID NO: 4688 - protein, 111 aa, Artificial Sequence
  Description of Artificial Sequence: Synthetic polypeptide
EVQLVQSGAEVKKPGESLRISCKGSGYIFTNYPIHWIRQSPSRGLEWLGFIDPGGGYDEPDERFRDRVTISADKSISTAYLQWSSLKASDTAMYYCARRGGGYYLDYWGQG

SEQ ID NO: 4689 - protein, 111 aa, Artificial Sequence
  Description of Artificial Sequence: Synthetic polypeptide
EVQLVQSGAEVKKPGESLRISCKGSGYIFTNYPIHWVRQAPGKGLEWVSFIDPGGGYDEPDERFRDRLTISKDTSKNQVVLTMTNMDPVDTATYYCARRGGGYYLDYWGQG

SEQ ID NO: 4690 - protein, 111 aa, Artificial Sequence
  Description of Artificial Sequence: Synthetic polypeptide
EVQLVQSGAEVKKPGESLRISCKGSGYIFTNYPIHWVRQAPGKGLEWVSFIDPGGGYDEPDERFRDRVTISVDTSKNQFSLKLSSVTAADTAVYYCARRGGGYYLDYWGQG

SEQ ID NO: 4691 - protein, 111 aa, Artificial Sequence
  Description of Artificial Sequence: Synthetic polypeptide
EVQLVQSGAEVKKPGESLRISCKGSGYIFTNYPIHWVRQAPGQGLEWMGFIDPGGGYDEPDERFRDRFVFSLDTSVSTAYLQICSLKAEDTAVYYCARRGGGYYLDYWGQG

SEQ ID NO: 4692 - protein, 111 aa, Artificial Sequence
  Description of Artificial Sequence: Synthetic polypeptide
EVQLVQSGAEVKKPGESLRISCKGSGYIFTNYPIHWVRQATGQGLEWMGFIDPGGGYDEPDERFRDRFTISRDDSKNTAYLQMNSLKTEDTAVYYCTRRGGGYYLDYWGQG

SEQ ID NO: 4693 - protein, 118 aa, Artificial Sequence
  Description of Artificial Sequence: Synthetic polypeptide
QVLLQQSAPELARPGASVKMSCTASGYIFTNYPIHWVKQRPGQGLEWIGFIDPGGGYDEPDERFRDRATLTADKSSSTAYMQLSSLTSEDSAIYYCARRGGGYYLDYWGQGTTLTVSS

SEQ ID NO: 4694 - protein, 111 aa, Artificial Sequence
  Description of Artificial Sequence: Synthetic polypeptide
QVQLQESGPGLVKPSQTLSLTCTVSGYIFTNYPIHWVRQAPGKGLEWVSFIDPGGGYDEPDERFRDRVTISVDTSKNQFSLKLSSVTAADTAVYYCARRGGGYYLDYWGQG

SEQ ID NO: 4695 - protein, 111 aa, Artificial Sequence; identical to SEQ ID NO: 4694
  Description of Artificial Sequence: Synthetic polypeptide

SEQ ID NO: 4696 - protein, 111 aa, Artificial Sequence; identical to SEQ ID NO: 4694
  Description of Artificial Sequence: Synthetic polypeptide

SEQ ID NO: 4697 - protein, 111 aa, Artificial Sequence
  Description of Artificial Sequence: Synthetic polypeptide
QVQLQESGPGLVKPSQTLSLTCTVSGYIFTNYPIHWVRQATGQGLEWMGFIDPGGGYDEPDERFRDRVTITADKSTSTAYMELSSLRSEDTAVYYCARRGGGYYLDYWGQG

SEQ ID NO: 4698 - protein, 118 aa, Artificial Sequence
  Description of Artificial Sequence: Synthetic polypeptide
QVQLVQSAPEVAKPGTSVKMSCKASGYIFTNYPIHWVKQAPGQGLEWIGFIDPGGGYDEPDERFRDRATLTADKSTSTAYMELSSLRSEDTAIYYCARRGGGYYLDYWGQGTLVTVSS

SEQ ID NO: 4699 - protein, 118 aa, Artificial Sequence
  Description of Artificial Sequence: Synthetic polypeptide
QVQLVQSGPEVAKPGSSVKVSCKASGYIFTNYPIHWVRQAPGQGLEWIGFIDPGGGYDEPDERFRDRATITADKSTSTAYMELSSLRSEDTAVYYCARRGGGYYLDYWGQGTLVTVSS

SEQ ID NO: 4700 - protein, 232 aa, Artificial Sequence
  Description of Artificial Sequence: Synthetic polypeptide
LNMERHWIFLFLLSVTAGVHSQVLLQQSAPELARPGASVKMSCTASGYIFTNYPIHWVKQRPGQGLEWIGFIDPGGGYDEPDERFRDRATLTADKSSSTAYMQLSSLTSEDSAIYYCARRGGGYYLDYWGQDTTLTVSAASTTPPSVKGEFFIDPGGGYDEPDERFRDRATLTADKSSSTAYMQLSSLTSEDSAIYYCARRGGGYYLDYWGQDTTLTVSAASTTPPSVKGEF

SEQ ID NO: 4701 - protein, 98 aa, Artificial Sequence
  Description of Artificial Sequence: Synthetic polypeptide
EVQLQQSVPELARPGASVKMSCTASGYIFTTYPIHWVKQRPGQGLEWIGFIDPGGGYDEPDDKFRDRATLTADKSSTTAYMQLSSLTSEDSAVYYCAR

SEQ ID NO: 4702 - protein, 121 aa, Artificial Sequence
  Description of Artificial Sequence: Synthetic polypeptide
QVQLQQSGAELAKPGASVRMSCKASGYTFTNYWIHWVKQRPGQGLEWIGYINPNTGYNDYNQKFKDKATLTADKSSSTVYMQLSSLTSEDSAVYYCARGGQLGLRRAMDYWGQGTSVTVSS

SEQ ID NO: 4703 - protein, 121 aa, Artificial Sequence
  Description of Artificial Sequence: Synthetic polypeptide
QVQLVQSGAEVKKPGASVKMSCKASGYTFTNYWIHWVRQAPGQGLEWIGYINPNTGYNDYNQKFKDRATLTADKSSSTVYMQLSSLRSEDTAVYYCARGGQLGLRRAMDYWGQGTLVTVSS

SEQ ID NO: 4704 - protein, 121 aa, Artificial Sequence
  Description of Artificial Sequence: Synthetic polypeptide
QVQLVQSGAEVAKPGASVKMSCKASGYTFTNYWIHWVKQRPGQGLEWIGYINPNTGYNDYNQKFKDKATLTADKSSSTVYMQLSSLTSEDTAVYYCARGGQLGLRRAMDYWGQGTLVTVSS

SEQ ID NO: 4705 - protein, 120 aa, Artificial Sequence
  Description of Artificial Sequence: Synthetic polypeptide
QVQLQQSGAEIVKPGASVKMSCKASGYTFTSYWINWVKQRPGQGLEWIGDIYPVRGITNYSEKFKNKAKMIPDTSSSTVYMQLSSLTSEDSAVYYCSRGNFGNFDAMDYWGQGTSVTVSS

SEQ ID NO: 4706 - protein, 120 aa, Artificial Sequence
  Description of Artificial Sequence: Synthetic polypeptide
QVQLVQSGAEIVKPGASVKMSCKASGYTFTSYWINWVKQAPGQGLEWIGDIYPVRGITNYSEKFKNKATMIPDTSTSTVYMELSSLRSEDTAVYYCSRGNFGNFDAMDYWGQGTMVTVSS

SEQ ID NO: 4707 - protein, 120 aa, Artificial Sequence
  Description of Artificial Sequence: Synthetic polypeptide
QVQLVQSGAEIVKPGASVKMSCKASGYTFTSYWINWVKQRPGQGLEWIGDIYPVRGITNYSEKFKNKAKMIPDTSTSTVYMQLSSLTSEDTAVYYCSRGNFGNFDAMDYWGQGTMVTVSS

SEQ ID NO: 4708 - protein, 120 aa, Artificial Sequence
  Description of Artificial Sequence: Synthetic polypeptide
QVQLVQSGAEVKKPGASVKMSCKASGYTFTSYWINWVRQAPGQGLEWIGDIYPVRGITNYSEKFKNKATMIPDTSTSTVYMELSSLRSEDTAVYYCSRGNFGNFDAMDYWGQGTMVTVSS

SEQ ID NO: 4709 - protein, 128 aa, Artificial Sequence
  Description of Artificial Sequence: Synthetic polypeptide
QVQLVQSGAEVKKPGASVKVSVKVSGYTLTELSMHWVRQAPGKGLEWMGGFDPEDGETIYAQMFQGRVTMTEDTSTDTAYMDLSSLRSEDTAVYYCATGTYYDILTGPSYYYYGLGVWGQGTTVTVSS

SEQ ID NO: 4710 - protein, 117 aa, Artificial Sequence
  Description of Artificial Sequence: Synthetic polypeptide
QVQLEQSGPGLVKPSQTLSLTCTVSGDSISSGGHYWSWIRQHPGKGLEWIGYIYYSGSSYYNPSLKSRFTISVDTSKNQFSLKLTSVTAADTAVYYCARTGDYFDYWGLGTLVTVSS

SEQ ID NO: 4711 - protein, 118 aa, Artificial Sequence
  Description of Artificial Sequence: Synthetic polypeptide
QSLEESGGRLVTPGTPLTLTCTVSGFDLSTYAMSWVRQAPGKGLEWIGAVSATTGNTYYATWAKGRFTMSKASTTVDLKITSPTTEDTATYFCVRYASSGVGTYFDLWGQGTLVTVSS

SEQ ID NO: 4712 - protein, 123 aa, Artificial Sequence
  Description of Artificial Sequence: Synthetic polypeptide
QSLEESGGGLVKPGASLTLTCTASGFSFSSGYWIFWVRQAPGKGLELVGGIYSGSSGTTYYANWAKGRFTISKTSSTTVTLQMTSLTAADTATYFCARSVDGIDSYDAAFNLWGPGTLVTVSS

SEQ ID NO: 4713 - protein, 123 aa, Artificial Sequence; identical to SEQ ID NO: 4712
  Description of Artificial Sequence: Synthetic polypeptide

SEQ ID NO: 4714 - protein, 122 aa, Artificial Sequence
  Description of Artificial Sequence: Synthetic polypeptide
QSLEESGGDLAKPGASLTITCTASGFSFSSSYWIFWVRQAPGKGLELIGGIYSSSGRMYYASWAKGRFTISKTSSTTMTLQMTSLTAADTATYFCARSADGSDSYDAYFTLWGPGTLVTVSS

SEQ ID NO: 4715 - protein, 115 aa, Artificial Sequence
  Description of Artificial Sequence: Synthetic polypeptide
QSLEESGGRLVTPGGSLTLTCTVSGFSLSNYHLGWVRRAPGKGLEWIGVITYGGSTYYASWVKGRFTISKTSTTVDLKMTSLTTEDTATYFCARRDSGGYHLDLWGQGTLVTISS

SEQ ID NO: 4716 - protein, 109 aa, Artificial Sequence
  Description of Artificial Sequence: Synthetic polypeptide
QSVEESGGRLVTPGGSLTLTCTVSGFSLSSNAINWVRQAPGEGLDWIGTIHTNTKTYYATWARGRFTISRTSSTTVDLKVTSLTAADTATYFCGRADLWGQGTLVTVSS

SEQ ID NO: 4717 - protein, 120 aa, Artificial Sequence
  Description of Artificial Sequence: Synthetic polypeptide
QVTLKESGPGILQPSQTLSLTCSFSGFSLSTSGMGVGWIRQPSGKGLEWLAHIWWDDVKSYNPALKSRLTISKDTSSSQVFLRIASVDTADTATYYCARIGDGYYSFDYWGQGTTLTVSS

SEQ ID NO: 4718 - protein, 120 aa, Artificial Sequence
  Description of Artificial Sequence: Synthetic polypeptide
QVTLKESGPTILQPTQTLTLTCTFSGFSLSTSGMGVGWIRQPSGKALEWIAHIWWDDVKSYNPALKSRLTITKDTSKSQVVLRIASVDPVDTATYYCARIGDGYYSFDYWGQGTTLTVSS

SEQ ID NO: 4719 - protein, 120 aa, Artificial Sequence
  Description of Artificial Sequence: Synthetic polypeptide
QVTLKESGPTILQPTQTLTLTCTFSGFSLSTSGMGVGWIRQPSGKGLEWIAHIWWDDVKSYNPALKSRLTITKDTSKSQVVLRIASVDTADTATYYCARIGDGYYSFDYWGQGTTLTVSS

SEQ ID NO: 4720 - protein, 120 aa, Artificial Sequence
  Description of Artificial Sequence: Synthetic polypeptide
QVTLKESGPTLVKPTQTLTLTCTFSGFSLSTSGMGVGWIRQPPGKALEWIAHIWWDDVKSYNPALKSRLTITKDTSKNQVVLRIASVDPVDTATYYCARIGDGYYSFDYWGQGTTLTVSS

SEQ ID NO: 4721 - protein, 116 aa, Artificial Sequence
  Description of Artificial Sequence: Synthetic polypeptide
QVQLVESGGGVVQPGRSLRLSCAASGFTFSCYGMHWVRQAPGKGLEWVAVIWYDGSNKYYADSVKGRFTISRDNSKNTLYLQMNSLRAEDTAVYYCAGGATAMDVWGQGTTVTVSS

SEQ ID NO: 4722 - protein, 126 aa, Artificial Sequence
  Description of Artificial Sequence: Synthetic polypeptide
QEQSGGGVVQPGRSLRLSCAASGFTFSNYGIHWVRQAPGKGLEWVAVIWYDGNNKYYADSVKGRFTISRDNSKNTLYLQMNSLRAEDTAVYYCARGGYYDSRGYYTPYYYYGMDVWGQGTTVTVSS

SEQ ID NO: 4723 - protein, 117 aa, Artificial Sequence
  Description of Artificial Sequence: Synthetic polypeptide
QVQLQESGPGLVKPSETLSLTCTVSGGSISIYYWSWIRQPPGKGLEWIGYIYYSGSTNYNPSLKSRVTISVDTSKNQFSLKLSSVTAADTAVYYCAVWNYGDAFDIWGQGTMVTVSS

SEQ ID NO: 4724 - protein, 111 aa, Artificial Sequence
  Description of Artificial Sequence: Synthetic polypeptide
EVQLVQSGAEVKKPGATVKISCKVSGYIFTNYPIHWVRQAPGKGLEWVSFIDPGGGYDEPDERFRDRFTISRDNAKNSLYLQMNSLRAEDTAVYYCARRGGGYYLDYWGQG

SEQ ID NO: 4725 - protein, 111 aa, Artificial Sequence; identical to SEQ ID NO: 4724
  Description of Artificial Sequence: Synthetic polypeptide

SEQ ID NO: 4726 - protein, 111 aa, Artificial Sequence; identical to SEQ ID NO: 4724
  Description of Artificial Sequence: Synthetic polypeptide

SEQ ID NO: 4727 - protein, 111 aa, Artificial Sequence; identical to SEQ ID NO: 4686
  Description of Artificial Sequence: Synthetic polypeptide

SEQ ID NO: 4728 - protein, 111 aa, Artificial Sequence; identical to SEQ ID NO: 4686
  Description of Artificial Sequence: Synthetic polypeptide

SEQ ID NO: 4729 - protein, 448 aa, Artificial Sequence
  Description of Artificial Sequence: Synthetic polypeptide
EVQLVESGGGLVQPGGSLRLSCAASGFSFSGRYWIQWVRQAPGKGLEWVASGWPGATGDTNYANWAKGRFTISRDDSKNTLYLQMNSLRAEDTAVYYCAREPVAWGGGLDLWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4730 - protein, 448 aa, Artificial Sequence
  Description of Artificial Sequence: Synthetic polypeptide
EVQLVESGGGLVQPGGSLRLSCAASGFSFSGRYWIQWVRQAPGKGLEWVASSSLRGTGDTNYANWAKGRFTISRDDSKNTLYLQMNSLRAEDTAVYYCAREPVAWGGGLDLWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4731 - protein, 448 aa, Artificial Sequence
  Description of Artificial Sequence: Synthetic polypeptide
EVQLVESGGGLVQPGGSLRLSCAASGFSFSGRYWIQWVRQAPGKGLEWVASVWPGFTGDTNYANWAKGRFTISRDDSKNTLYLQMNSLRAEDTAVYYCAREPVAWGGGLDLWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4732 - protein, 448 aa, Artificial Sequence
  Description of Artificial Sequence: Synthetic polypeptide
EVQLVESGGGLVQPGGSLRLSCAASGFSLSGRYWIQWVRQAPGKGLEWVASGWPGATGDTNYANWAKGRFTISRDDSKNTLYLQMNSLRAEDTAVYYCAREPVAWGGGLDLWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4733 - protein, 448 aa, Artificial Sequence
  Description of Artificial Sequence: Synthetic polypeptide
EVQLVESGGGLVQPGGSLRLSCAASGFSLSGRYWIQWVRQAPGKGLEWVASVWPGFTGDTNYANWAKGRFTISRDDSKNTLYLQMNSLRAEDTAVYYCAREPVAWGGGLDLWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4734 - protein, 449 aa, Artificial Sequence
  Description of Artificial Sequence: Synthetic polypeptide
EVQLVESGGGLVQPGGSLRLSCAASGFSFSGRYWIQKYVRQAPGKGLEWVASVWPGITGDTNYANWAKGRFTISRDDSKNTLYLQMNSLRAEDTAVYYCAREPVAWGGGLDLWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4735 - protein, 220 aa, Artificial Sequence
  Description of Artificial Sequence: Synthetic polypeptide
EVQLVQSGAEVKKPGSSVKVSCKASGGTFSSYAISWVRQAPGQGLEWMGRIIPIFGTANYAQKFQGRVTITADESTSTAYMELSSLRSEDTAVYYCARHGGYIFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4736 - protein, 220 aa, Artificial Sequence
  Description of Artificial Sequence: Synthetic polypeptide
EVQLVQSGAEVKKPGSSVKVSCKASGGTFSSYAISWVRQAPGQGLEWMGRIIPIFGTANYAQKFQGRVTITADESTSTAYMELSSLRSEDTAVYYCARHGGYVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4737 - protein, 220 aa, Artificial Sequence; identical to SEQ ID NO: 4735
  Description of Artificial Sequence: Synthetic polypeptide

SEQ ID NO: 4738 - protein, 220 aa, Artificial Sequence
  Description of Artificial Sequence: Synthetic polypeptide
EVQLVQSGAEVKKPGSSVKVSCKASGGTFSSYAISWVRQAPGQGLEWMGRIIPIFGTANYAQKFQGRVTITADESTSTAYMELSSLRSEDTAVYYCARHGGYYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4739 - protein, 220 aa, Artificial Sequence; identical to SEQ ID NO: 4736
  Description of Artificial Sequence: Synthetic polypeptide

SEQ ID NO: 4740 - protein, 220 aa, Artificial Sequence
  Description of Artificial Sequence: Synthetic polypeptide
EVQLVQSGAEVKKPGSSVKVSCKASGGTFSSYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4741 - protein, 220 aa, Artificial Sequence
  Description of Artificial Sequence: Synthetic polypeptide
EVQLVQSGAEVKKPGSSVKVSCKASGGTFQSYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4742 - protein, 220 aa, Artificial Sequence
  Description of Artificial Sequence: Synthetic polypeptide
EVQLVQSGAEVKKPGSSVKVSCKASGGTFNAYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4743 - protein, 220 aa, Artificial Sequence
  Description of Artificial Sequence: Synthetic polypeptide
EVQLVQSGAEVKKPGSSVKVSCKASGGTFGSYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4744 - protein, 220 aa, Artificial Sequence
  Description of Artificial Sequence: Synthetic polypeptide
EVQLVQSGAEVKKPGSSVKVSCKASGGTFSSYAISWVRQAPGQGLEWMGPINPYYGDAIYAQKFQGRVTITADESTSTAYMELSSLRSEDTAVYYCARYYSDYMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4745 - protein, 220 aa, Artificial Sequence
  Description of Artificial Sequence: Synthetic polypeptide
EVQLVQSGAEVKKPGSSVKVSCKASGGTFTSYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4746 - protein, 220 aa, Artificial Sequence; identical to SEQ ID NO: 4745
  Description of Artificial Sequence: Synthetic polypeptide

SEQ ID NO: 4747 - protein, 220 aa, Artificial Sequence; identical to SEQ ID NO: 4741
  Description of Artificial Sequence: Synthetic polypeptide

SEQ ID NO: 4748 - protein, 220 aa, Artificial Sequence; identical to SEQ ID NO: 4740
  Description of Artificial Sequence: Synthetic polypeptide

SEQ ID NO: 4749 - protein, 229 aa, Artificial Sequence
  Description of Artificial Sequence: Synthetic polypeptide
EVQLVQSGAEVKKPGASVKVSCKASGYTFTSHYMHWVRQAPGQGLEWMGKINADLGDTNYAQKFQGRVTMTRDTSISTAYMELSSLRSEDTAVYYCARDGIEHGGHYYWGYLFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4750 - protein, 446 aa, Artificial Sequence
  Description of Artificial Sequence: Synthetic polypeptide
EVQLVQSGAEVKKPGSSVKVSCKASGGTFSSYAISWVRQAPGQGLEWMGGIGPFFGTANYAQKFQGRVTITADESTSTAYMELSSLRSEDTAVYYCARDTPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4751 - protein, 446 aa, Artificial Sequence
  Description of Artificial Sequence: Synthetic polypeptide
EVQLVQSGAEVKKPGESLKISCKGSGYSFTNYISWVRQMPGKGLEWMGIIDPDDSYTEYSPSFQGQVTISADKSISTAYLQWSSLKASDTAMYYCARYEYGGFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4752 - protein, 109 aa, Artificial Sequence
  Description of Artificial Sequence: Synthetic polypeptide
ESALTQPASVSGSPGQSITISCTGTSSDIGTYNYVSWYQQHPGKAPKLMIYDDSNRPSGVSNRFSGSKSGNTASLTISGLQAEDEADYYCQSYDSQSIVFGGGTKLTVL

SEQ ID NO: 4753 - protein, 446 aa, Artificial Sequence
  Description of Artificial Sequence: Synthetic polypeptide
EVQLVQSGAEVKKPGESLKISCKGSGYSFTNYISWVRQMPGKGLEWMGIIDPDDSYTRYSPSFQGQVTISADKSISTAYLQWSSLKASDTAMYYCARYEYGGFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4754 - protein, 447 aa, Artificial Sequence
  Description of Artificial Sequence: Synthetic polypeptide
EVQLVQSGAEVKKPGESLKISCKGSGYSFTSYYIGWVRQMPGKGLEWMGIIDPTDSQTAYSPSFQGQVTISADKSISTAYLQWSSLKASDTAMYYCARYMMRGFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4755 - protein, 224 aa, Artificial Sequence
  Description of Artificial Sequence: Synthetic polypeptide
EVQLVQSGAEVKKPGESLKISCKGSGYSFTNYWIGWVRQMPGKGLEWMGRIDPGESLTNYAPSFQGQVTISADKSISTAYLQWSSLKASDTAMYYCARTGVADVDMPFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4756 - protein, 220 aa, Artificial Sequence
  Description of Artificial Sequence: Synthetic polypeptide
EVQLVQSGAEVKKPGSSVKVSCKASGGTFNSYAISWVRQAPGQGLEWMGRIIPIFGTANYAQKFQGRVTITADESTSTAYMELSSLRSEDTAVYYCARHGGYSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4757 - protein, 229 aa, Artificial Sequence
  Description of Artificial Sequence: Synthetic polypeptide
EVQLVQSGAEVKKPGASVKVSCKASGYTFTSHYMHWVRQAPGQGLEWMGNINPVDGGTEYAQKFQGRVTMTRDTSISTAYMELSSLRSEDTAVYYCARDGIEHGGHYYWGYLFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4758 - protein, 220 aa, Artificial Sequence; identical to SEQ ID NO: 4756
  Description of Artificial Sequence: Synthetic polypeptide

SEQ ID NO: 4759 - protein, 220 aa, Artificial Sequence; identical to SEQ ID NO: 4738
  Description of Artificial Sequence: Synthetic polypeptide

SEQ ID NO: 4760 - protein, 119 aa, Artificial Sequence
  Description of Artificial Sequence: Synthetic polypeptide
EVQLVESGGGLVKPGGSLRLSCAASGYTFTDEYMNWVHQAPGKSLEWVGYINPNNGGADYNPSLKSRVTISVDQSKSIAYLQMNSLKTEDTAVYFCARLGYSNPYFDFWGQGTLVTVSS

SEQ ID NO: 4761 - protein, 119 aa, Artificial Sequence
  Description of Artificial Sequence: Synthetic polypeptide
QVQLVQSGSELKKPGASVKVSCKASGYTFTDEYMNWVRQAPGKSLEWMGYINPNNGGADYNQKFQGRVTMTVNQSISTAYMELSRLRSDDTAVYFCARLGYSNPYFDFWGQGTLVTVSS

SEQ ID NO: 4762 - protein, 107 aa, Artificial Sequence
  Description of Artificial Sequence: Synthetic polypeptide
DIVLTQSPATLSLSPGERATLSCRASQDVNTAVAWYQQKPDQSPKLLIYWASTRHTGVPARFTGSGSGTDYTLTISSLQPEDFAVYFCQQHHVSPWTFGGGTKVEIK

SEQ ID NO: 4763 - protein, 107 aa, Artificial Sequence
  Description of Artificial Sequence: Synthetic polypeptide
DIVLTQSPATLSLSPGERATLSCRASQDVNTAVAWYQQKPGKSPKLLIYWASTRHTGVPARFTGSGSGTDYTLTISSLQPEDFAVYFCQQHHVSPWTFGGGTKVEIK

SEQ ID NO: 4764 - protein, 107 aa, Artificial Sequence
  Description of Artificial Sequence: Synthetic polypeptide
DIVLTQSPSFLSASVGDRVTITCQASQDVNTAVAWYQQKPGKSPKLLIYWASTRHTGVPARFTGSGSGTDYTLTISSLQPEDFAVYFCQQHHVSPWTFGGGTKVEIK

SEQ ID NO: 4765 - protein, 119 aa, Artificial Sequence
  Description of Artificial Sequence: Synthetic polypeptide
EVQLVQSGAEVKKPGASVKVSCKASGYTFTDEYMNWVRQAPGKSLEWVGYINPNNGGADYNQKFQGRVTITVDQSASTAYMELSSLRSEDTAVYFCARLGYSNPYFDFWGQGTLVTVSS

SEQ ID NO: 4766 - protein, 446 aa, Artificial Sequence; identical to SEQ ID NO: 4750
  Description of Artificial Sequence: Synthetic polypeptide

SEQ ID NO: 4767 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARRGLRYNYFDYWGQGTTLTVSS

SEQ ID NO: 4768 - protein, 119 aa, Artificial Sequence
  Description of Artificial Sequence: Synthetic polypeptide
EVQLLESGGGLVQPGGSPRLSCAASGFTFSSYAMSWVRQAPGKGLEWVSAISGSGGSTYYADSVKGRFTISRDNSKNTLYLQMNSLRAEDTAVYYCARRGLRYNYFDYWGQGTTLTVSS

SEQ ID NO: 4769 - protein, 118 aa, Artificial Sequence
  Description of Artificial Sequence: Synthetic polypeptide
EVQLLESGGGLVQPGGSLRLSCAASGFTFSSYAMTWVRQAPGKGLEWVSVISGSGSTYYADSVKGRFTISRDNSKNTLYLQMNSLRAEDTAVYYCARRGLRYNYFDYWGQGTTLTVSS

SEQ ID NO: 4770 - protein, 118 aa, Artificial Sequence
  Description of Artificial Sequence: Synthetic polypeptide
EVQLLESGGGLVQPGGSLRLSCAASGFTFSSYAMTWVRQAPGKGLEWVSAISGSGSTYYADSVKGRFTISRDNSKNTLYLQMNSLRAEDTAVYYCARRGLRYNYFDYWGQGTTLTVSS

SEQ ID NO: 4771 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCARRGLRYNYFDYWGQGTTLTVSS

SEQ ID NO: 4772 - protein, 119 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARRGLRYKYFDYWGQGTTLTVSS

SEQ ID NO: 4773 - protein, 468 aa, Artificial Sequence
  Description of Artificial Sequence: Synthetic polypeptide
MGWSCIILFLVATATGVHSLEQVQLVQSGAEVKKPGASVKVSCKASGHIFSNYWIQWVRQAPGQGLEWMGEILPGSGHTEYTENFKDRVTMTRDTSTSTVYMELSSLRSEDTAVYYCARYFFGSSPNWYFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENYKTTPPVLDSDGSFFLYSRLTVDKSRWQEGNVFSCSVMHEALHNHYTQKSLSLSLGK

SEQ ID NO: 4774 - protein, 468 aa, Artificial Sequence; identical to SEQ ID NO: 4773
  Description of Artificial Sequence: Synthetic polypeptide

SEQ ID NO: 4775 - protein, 468 aa, Artificial Sequence
  Description of Artificial Sequence: Synthetic polypeptide
MGWSCIILFLVATATGVHSLEQVQLVQSGAEVKKPGASVKVSCKASGYIFSNYWIQWVRQAPGQGLEWMGEILPGSGSTEYTENFKDRVTMTRDTSTSTVYMELSSLRSEDTAVYYCARYFFGSSPNWYFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENYKTTPPVLDSDGSFFLYSRLTVDKSRWQEGNVFSCSVMHEALHNHYTQKSLSLSLGK

SEQ ID NO: 4776 - protein, 446 aa, Artificial Sequence
  Description of Artificial Sequence: Synthetic polypeptide
QVQLQQPGAELVRPGTSVKLSCKASGYTFTSSWMHWVKQRPGQGLEWIGVIDPHDSYTNYNQKFKGKATLTVDTSSSTAYMQLSSLTSEDSAVYYCARGGGSSYNRYFDVWGTGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENYKTTPPVLDSDGSFFLYSRLTVDKSRWQEGNVFSCSVMHEALHNHYTQKSLSLSLGK

SEQ ID NO: 4777 - protein, 446 aa, Artificial Sequence
  Description of Artificial Sequence: Synthetic polypeptide
QVQLQQPGAELVRPGTSVKLSCKASGYTFTSSWMHWVKQRPGQGLEWIGVIDPHDSYTNYNQKFKGKATLTVDTSSSTAYMQLSSLTSEDSAVYYCARGGGSSYNRYFDVWGTGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENYKTTPPVLDSDGSFFLYSRLTVDKSRWQEGNVFSCSVLHEALHSHYTQKSLSLSLGK

SEQ ID NO: 4778 - protein, 446 aa, Artificial Sequence
  Description of Artificial Sequence: Synthetic polypeptide
QVQLQQPGAELVRPGTSVKLSCKASGYTFTSSWMHWVKQRPGQGLEWIGVIDPSDSYTNYNQKFKGKATLTVDTSSSTAYMQLSSLTSEDSAVYYCARGGGSSYNRYFDVWGTGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENYKTTPPVLDSDGSFFLYSRLTVDKSRWQEGNVFSCSVMHEALHNHYTQKSLSLSLGK

SEQ ID NO: 4779 - protein, 447 aa, Artificial Sequence
  Description of Artificial Sequence: Synthetic polypeptide
QVQLVQSGAEVKKPGASVKVSCKASGYTFTDYSMDWVRQAPGQGLEWMGAINPNSGGTNYNQKFKDRVTMTRDTSTSTVYMELSSLRSEDTAVYYCARSGSYDGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 4780 - protein, 447 aa, Artificial Sequence
  Description of Artificial Sequence: Synthetic polypeptide
QVQLVQSGAEVKKPGASVKVSCKASGYTFTDYSMDWVRQAPGQGLEWMGAINPNSGGTNYNQKFKDRVTMTRDTSTSTVYMELSSLRSEDTAVYYCARSGSYDGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4781 - protein, 446 aa, Artificial Sequence
  Description of Artificial Sequence: Synthetic polypeptide
QVQLVQSGAEVKKPGASVKVSCKASGYTFTDYSMDWVRQAPGQGLEWMGAIHLNTGYTNYNQKFKGRVTMTRDTSTSTVYMELSSLRSEDTAVYYCARGFYDGYSPMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 4782 - protein, 446 aa, Artificial Sequence
  Description of Artificial Sequence: Synthetic polypeptide
QVQLVQSGAEVKKPGASVKVSCKASGYTFTDYSMDWVRQAPGQGLEWMGAIHLNTGYTNYNQKFKGRVTMTRDTSTSTVYMELSSLRSEDTAVYYCARGFYDGYSPMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4783 - protein, 446 aa, Artificial Sequence
  Description of Artificial Sequence: Synthetic polypeptide
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4784 - protein, 449 aa, Artificial Sequence
  Description of Artificial Sequence: Synthetic polypeptide
DVKLVESGGGLVKLGGSLKLSCAASGFTFSNYYMSWVRQTPEKRLELVAAINSDGGITYYLDTVKGRFTISRDNAKNTLYLQMSSLKSEDTALFYCARHRSGYFSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4785 - protein, 447 aa, Artificial Sequence
  Description of Artificial Sequence: Synthetic polypeptide
EVQLVESGGGLVKPGGSLRLSCAASGFTFSAYAMNWVRQAPGKGLEWVGRIRTKNNNYATYYADSVKDRFTISRDDSKNTLYLQMNSLKTEDTAVYYCTTFYGNGVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4786 - protein, 449 aa, Artificial Sequence
  Description of Artificial Sequence: Synthetic polypeptide
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4787 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWIGRVNPYHGGATYNQKFKGKATITVDKSTSTAYMELSSLRSEDTAVYYCAREENSYDGYYGMDYWGQGTLVTVSS

SEQ ID NO: 4788 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGATYNQKFKGRVTITADKSTSTAYMELSSLRSEDTAVYYCAREENSYDGYYGMDYWGQGTLVTVSS

SEQ ID NO: 4789 - protein, 122 aa, Artificial Sequence
  Description of Artificial Sequence: Synthetic polypeptide
QVQLVASGAEVKKPGSSVKVSCKASGYTFTDYYMDWVRQAPGQGLEWMGRVNPYHGGATYNQKFKGRVTITADKSTSTAYMELSSLRSEDTAVYYCAREENSYDGYYGMDYWGQGTLVTVSS

SEQ ID NO: 4790 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGGATYNQKFKGRVTITADKSTSTAYMELSSLRSEDTAVYYCAREENSYDGYYGMDYWGQGTLVTVSS

SEQ ID NO: 4791 - protein, 122 aa, Artificial Sequence
  Description of Artificial Sequence: Synthetic polypeptide
QVQLVQSGAEVKKPGSSVKVSCKASGYTFTKYYMDWVRQAPGQGLEWMGRVNPYHGGATYNQKFKGRVTITADKSTSTAYMELSSLRSEDTAVYYCAREENSYDGYYGMDYWGQGTLVTVSS

SEQ ID NO: 4792 - protein, 122 aa, Artificial Sequence
  Description of Artificial Sequence: Synthetic polypeptide
EVQLQQSGPELVKPGASVKMSCKASGYTFTDYYMDWVKQSHGESFEWIGRVNPYHGGATYNQKFKGKATLTVDKSSRTAYMELNSLTYEDSAVYYCAREENSYDGYYGMDYWGQGTTVTVSS

SEQ ID NO: 4793 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGFATYNQKFKGRVTITADKSTSTAYMELSSLRSEDTAVYYCAREENSYDGYYGMDYWGQGTLVTVSS

SEQ ID NO: 4794 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGWATYNQKFKGRVTITADKSTSTAYMELSSLRSEDTAVYYCAREENSYDGYYGMDYWGQGTLVTVSS

SEQ ID NO: 4795 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGYATYNQKFKGRVTITADKSTSTAYMELSSLRSEDTAVYYCAREENSYDGYYGMDYWGQGTLVTVSS

SEQ ID NO: 4796 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGGTYNQKFKGRVTITADKSTSTAYMELSSLRSEDTAVYYCAREENSYDGYYGMDYWGQGTLVTVSS

SEQ ID NO: 4797 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGAFYNQKFKGRVTITADKSTSTAYMELSSLRSEDTAVYYCAREENSYDGYYGMDYWGQGTLVTVSS

SEQ ID NO: 4798 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGAVYNQKFKGRVTITADKSTSTAYMELSSLRSEDTAVYYCAREENSYDGYYGMDYWGQGTLVTVSS

SEQ ID NO: 4799 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGAWYNQKFKGRVTITADKSTSTAYMELSSLRSEDTAVYYCAREENSYDGYYGMDYWGQGTLVTVSS

SEQ ID NO: 4800 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGATFNQKFKGRVTITADKSTSTAYMELSSLRSEDTAVYYCAREENSYDGYYGMDYWGQGTLVTVSS

SEQ ID NO: 4801 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGATPNQKFKGRVTITADKSTSTAYMELSSLRSEDTAVYYCAREENSYDGYYGMDYWGQGTLVTVSS

SEQ ID NO: 4802 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGATVNQKFKGRVTITADKSTSTAYMELSSLRSEDTAVYYCAREENSYDGYYGMDYWGQGTLVTVSS

SEQ ID NO: 4803 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGATYNQKFKGRVTITADKSTSTAYMELSSLRSEDTAVYYCAREDNSYDGYYGMDYWGQGTLVTVSS

SEQ ID NO: 4804 - protein, 122 aa, Artificial Sequence
  Description of Artificial Sequence: Synthetic polypeptide
QVQLVQSGAEVKKPGSSVKVSCKASGYTFTDYYMDWVRQAPGQGLEWMGRVNPYHGGATYNQKFKGRVTITADKSTSTAYMELSSLRSEDTAVYYCAREENSYTGYYGMDYWGQGTLVTVSS

SEQ ID NO: 4805 - protein, 122 aa, Artificial Sequence
  Description of Artificial Sequence: Synthetic polypeptide
QVQLVASGAEVKKPGSSVKVSCKASGYTFTKYYMDWVRQAPGQGLEWMGRVNPYHGGATYNQKFKGRVTITADKSTSTAYMELSSLRSEDTAVYYCAREENSYDGYYGMDYWGQGTLVTVSS

SEQ ID NO: 4806 - protein, 122 aa, Artificial Sequence
  Description of Artificial Sequence: Synthetic polypeptide
QVQLVQSGAEVKKPGSSVKVSCTASGYTFTKYYMDWVRQAPGQGLEWMGRVNPYHGGATYNQKFKGRVTITADKSTSTAYMELSSLRSEDTAVYYCAREENSYDGYYGMDYWGQGTLVTVSS

SEQ ID NO: 4807 - protein, 122 aa, Artificial Sequence
  Description of Artificial Sequence: Synthetic polypeptide
QVQLVASGAEVKKPGSSVKVSCKASGYTFTDYYMDWVRQAPGQGLEWMGRVNPYHGFATYNQKFKGRVTITADKSTSTAYMELSSLRSEDTAVYYCAREENSYDGYYGMDYWGQGTLVTVSS

SEQ ID NO: 4808 - protein, 122 aa, Artificial Sequence
  Description of Artificial Sequence: Synthetic polypeptide
QVQLVASGAEVKKPGSSVKVSCKASGYTFTDYYMDWVRQAPGQGLEWMGRVNPYHGYATYNQKFKGRVTITADKSTSTAYMELSSLRSEDTAVYYCAREENSYDGYYGMDYWGQGTLVTVSS

SEQ ID NO: 4809 - protein, 122 aa, Artificial Sequence
  Description of Artificial Sequence: Synthetic polypeptide
QVQLVASGAEVKKPGSSVKVSCKASGYTFTDYYMDWVRQAPGQGLEWMGRVNPYHGGAFYNQKFKGRVTITADKSTSTAYMELSSLRSEDTAVYYCAREENSYDGYYGMDYWGQGTLVTVSS

SEQ ID NO: 4810 - protein, 122 aa, Artificial Sequence
  Description of Artificial Sequence: Synthetic polypeptide
QVQLVASGAEVKKPGSSVKVSCKASGYTFTDYYMDWVRQAPGQGLEWMGRVNPYHGGATFNQKFKGRVTITADKSTSTAYMELSSLRSEDTAVYYCAREENSYDGYYGMDYWGQGTLVTVSS

SEQ ID NO: 4811 - protein, 122 aa, Artificial Sequence
  Description of Artificial Sequence: Synthetic polypeptide
QVQLVASGAEVKKPGSSVKVSCKASGYTFTDYYMDWVRQAPGQGLEWMGRVNPYHGGATVNQKFKGRVTITADKSTSTAYMELSSLRSEDTAVYYCAREENSYDGYYGMDYWGQGTLVTVSS

SEQ ID NO: 4812 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGFATYNQKFKGRVTITADKSTSTAYMELSSLRSEDTAVYYCAREENSYDGYYGMDYWGQGTLVTVSS

SEQ ID NO: 4813 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGYATYNQKFKGRVTITADKSTSTAYMELSSLRSEDTAVYYCAREENSYDGYYGMDYWGQGTLVTVSS

SEQ ID NO: 4814 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGGAFYNQKFKGRVTITADKSTSTAYMELSSLRSEDTAVYYCAREENSYDGYYGMDYWGQGTLVTVSS

SEQ ID NO: 4815 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGGATFNQKFKGRVTITADKSTSTAYMELSSLRSEDTAVYYCAREENSYDGYYGMDYWGQGTLVTVSS

SEQ ID NO: 4816 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGGATVNQKFKGRVTITADKSTSTAYMELSSLRSEDTAVYYCAREENSYDGYYGMDYWGQGTLVTVSS

SEQ ID NO: 4817 - protein, 122 aa, Artificial Sequence
  Description of Artificial Sequence: Synthetic polypeptide
QVQLVQSGAEVKKPGSSVKVSCTASGYTFTDYYMDWVRQAPGQGLEWMGRVNPYHGGATYNQKFKGRVTITADKSTSTAYMELSSLRSEDTAVYYCAREENSYTGYYGMDYWGQGTLVTVSS

SEQ ID NO: 4818 - protein, 118 aa, Artificial Sequence
  Description of Artificial Sequence: Synthetic polypeptide
EVKLQESGGGLVQPGGSLNLSCTASGFDFSRYWMSWARQAPGKGQEWIGEINPGSSTINYTPSLKDKFIISRDNAKNTLYLQMSKVRSEDTALYYCARQGTYYTMDYWGQGTTVTVSS

SEQ ID NO: 4819 - protein, 120 aa, Artificial Sequence
  Description of Artificial Sequence: Synthetic polypeptide
QVQLVQSGGGVVQPGRSLRLSCAASGVSLPDYGVSWVRQAPRKGLEWVAVIWGSETTYYNSALKSRFTISRDNSKNTLYLQMNSLRAEDTAVYYCARHYYYGGSYAMDYWGQGTLVTVSS

SEQ ID NO: 4820 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4821 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHDDPEVKFNWYVDGVEVHNAKTKPREEQYNATYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4822 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVNNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4823 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHDDPEVKFNWYVDGVEVHNAKTKPREEQYNATYRVVSVLTVLHQDWLNGKEYKCKVNNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4824 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVNNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4825 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4826 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFKWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4827 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIERTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4828 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFKWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4829 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFKWYVDGVEVHNAKTKPREEQYNSTYRVVSVLTVLHQDWLNGKEYKCKVSNKALPAPIERTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4830 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 4831 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDFTLTISSLQPEDFATYYCQQGNVLPYTFGPGTKVDIK

SEQ ID NO: 4832 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDFTLTISSLQPEDFATYYCQQGNALPYTFGPGTKVDIK

SEQ ID NO: 4833 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYWYGGSYAMDYWGQGTLVTVSS

SEQ ID NO: 4834 - protein, 120 aa, Artificial Sequence
  Description of Artificial Sequence: Synthetic polypeptide
QVQLVQSGGGVVQPGRSLRLSCAASGVSLPDFGVSWVRQAPGKGLEWVAVIWGSETTYYNSALKSRFTISRDNSKNTLYLQMNSLRAEDTAVYYCAKHYFYGGSYAMDYWGQGTLVTVSS

SEQ ID NO: 4835 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4836 - protein, 450 aa, Artificial Sequence
  Description of Artificial Sequence: Synthetic polypeptide
EVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4837 - protein, 450 aa, Artificial Sequence
  Description of Artificial Sequence: Synthetic polypeptide
QVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4838 - protein, 115 aa, Artificial Sequence
  Description of Artificial Sequence: Synthetic polypeptide
LESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDNWGQGTTVT

SEQ ID NO: 4839 - protein, 114 aa, Artificial Sequence
  Description of Artificial Sequence: Synthetic polypeptide
LESGAELVRPGASVKISCKASGYAFSSSWMNWVKQRPGQGLEWIGRIYPGDGDTNYNGKFKEAATLTADKSSSTAYMQLSSLTSVDSAVYSCARSEYWGNYWAMDYWGQGTTVT

SEQ ID NO: 4840 - protein, 450 aa, Artificial Sequence
  Description of Artificial Sequence: Synthetic polypeptide
QVQLVQPGAEVVKPGASVKLSCKTSGYTFTSNWMHWVKQAPGQGLEWIGEIDPSDSYTNYNQNFQGKAKLTVDKSTSTAYMEVSSLRSDDTAVYYCARGSNPYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4841 - protein, 451 aa, Artificial Sequence
  Description of Artificial Sequence: Synthetic polypeptide
EVQLVESGGGLVQPGGSLRLSCAASGFTFSSSWMNWVRQAPGKGLEWVGRIYPGDGDTNYNVKFKGRFTISRDDSKNSLYLQMNSLKTEDTAVYYCARSGFITTVRDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4842 - protein, 451 aa, Artificial Sequence
  Description of Artificial Sequence: Synthetic polypeptide
QVQLQQPGAELVRPGTSVKLSCKASGYTFTSYWMHWIKQRPGQGLEWIGVIDPSDNYTKYNQKFKGKATLTVDTSSSTAYMQLSSLTSEDSAVYFCAREGYYGSSPWFAYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVPAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 4843 - protein, 121 aa, Artificial Sequence
  Description of Artificial Sequence: Synthetic polypeptide
QVQLVQSGAEVKKPGSSVKVSCKASGYTFTSYNMHWVRQAPGQGLEWIGAIYPGNGDTSYNQKFKGKATITADKSTSTAYMELSSLRSDDTAVYYCARSTYYAGDWNFNDWGQGTLVTVSS

SEQ ID NO: 4844 - protein, 471 aa, Artificial Sequence
  Description of Artificial Sequence: Synthetic polypeptide
MGWSCIILFLVATATGVHSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4845 - protein, 471 aa, Artificial Sequence
  Description of Artificial Sequence: Synthetic polypeptide
MGWSCIILFLVATATGVMSEVQLVESGCGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDFEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDCSFFLYSKLTVDKSRWQQGNVFSCSVMHEALHNHYTQKSLSLSPGK

SEQ ID NO: 4846 - protein, 448 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4847 - protein, 253 aa, Artificial Sequence
  Description of Artificial Sequence: Synthetic polypeptide
MKKNIAFLLASMFVFSIATNAYAQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 4848 - protein, 471 aa, Artificial Sequence
  Description of Artificial Sequence: Synthetic polypeptide
MGWSCIILFLVATATGVHSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4849 - protein, 471 aa, Artificial Sequence; identical to SEQ ID NO: 4844
  Description of Artificial Sequence: Synthetic polypeptide

SEQ ID NO: 4850 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4851 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSASYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4852 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSASYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4853 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSASYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNKALPAPIAATISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4854 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSASYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCAVSNKALPAPIEATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4855 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSASYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNAALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4856 - protein, 443 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 4857 - protein, 471 aa, Artificial Sequence; identical to SEQ ID NO: 4844
  Description of Artificial Sequence: Synthetic polypeptide

SEQ ID NO: 4858 - protein, 452 aa, Artificial Sequence; identical to SEQ ID NO: 4850
  Description of Artificial Sequence: Synthetic polypeptide

SEQ ID NO: 4859 - protein, 447 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARWYYSNSYWYFDWGQGTLVTVSSASTKGPSVFPLAPSSKSTSGGTAALGCLVKDYFPEPVTVSWNSGALTSGVHTFPAVLQSSGLYSLSSWWPSSSLGTQTYICNVNHKPSNTKVDKKVEPKSCDKTHTCPPCPAPELLGGPSVFLFPPKPKDTLMISRTPEVTCVWDVSHEDPEVKFNWYVDGVEVHNAKTKPREEQYNATYRVVSVLTVLHQDWLNGKEYKCKVSNKALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4860 - protein, 468 aa, Artificial Sequence
  Description of Artificial Sequence: Synthetic polypeptide
MEFGLSWVFLVAILRGVQCQVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPASKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4861 - protein, 469 aa, Artificial Sequence
  Description of Artificial Sequence: Synthetic polypeptide
MEFGLSWVFLVAILRGVQCQVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4862 - protein, 235 aa, Artificial Sequence
  Description of Artificial Sequence: Synthetic polypeptide
MDFQVQIISFLLISASVIMSRGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4863 - protein, 114 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARTAMDYWGQGTLVTVSS

SEQ ID NO: 4864 - protein, 115 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARSSWFDYWGQGTLVTVSS

SEQ ID NO: 4865 - protein, 117 aa, Artificial Sequence
  Description of Artificial Sequence: Synthetic polypeptide
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARYGGNYFDYWGQGTLVTVSS

SEQ ID NO: 4866 - protein, 111 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAFDYWGQGTLVTVSS

SEQ ID NO: 4867 - protein, 118 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYYYYYGMDVWGQGTTVTVSS

SEQ ID NO: 4868 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYSGSYYAFDIWGQGTMVTVSS

SEQ ID NO: 4869 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARVGATNYYYGMDVWGQGTTVTVSS

SEQ ID NO: 4870 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARTGTYYYGMDVWGQGTTVTVSS

SEQ ID NO: 4871 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYYGSGSAFDIWGQGTMVTVSS

SEQ ID NO: 4872 - protein, 117 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYGSGSFDYWGQGTLVTVSS

SEQ ID NO: 4873 - protein, 116 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYYDSSDYWGQGTLVTVSS

SEQ ID NO: 4874 - protein, 119 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDFWSGYYFDYWGQGTLVTVSS

SEQ ID NO: 4875 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDFWSGYYTGMDVWGQGTTVTVSS

SEQ ID NO: 4876 - protein, 117 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARDYSNAFDIWGQGTMVTVSS

SEQ ID NO: 4877 - protein, 117 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARYSSGAFDVWGQGTMVTVSS

SEQ ID NO: 4878 - protein, 117 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARWNFDYWGQGTLVTVSS

SEQ ID NO: 4879 - protein, 445 aa, Artificial Sequence
  Description of Artificial Sequence: Synthetic polypeptide
QLQLVQSGPELKKPGETVKISCKASGYSFTNYGMNWVKQAPGKGLKWMGWINTYTGEPSYADDFKGRFAFSLETSASTAYLQISNLKNEDTATYFCARGAYYRYDLGMDYWGQGTSVTVSSAKTTPPSVYPLAPGSAAQTNSMVTLGCLVKGYFPEPVTVTWNSGSLSSGVHTFPAVLESDLYTLSSSVTVPSSMRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 4880 - protein, 121 aa, Artificial Sequence
  Description of Artificial Sequence: Synthetic polypeptide
QLQLVQSGPELKKPGETVKISCKASGYSFTNYGMNWVKQAPGKGLKWMGWINTYTGEPSYADDFKGRFAFSLETSASTAYLQISNLKNEDTATYFCARGAYYRYDLGMDYWGQGTSVTVSS

SEQ ID NO: 4881 - protein, 121 aa, Artificial Sequence
  Description of Artificial Sequence: Synthetic polypeptide
ELQLVQSGGELKKPGETVRISCAASGYTFTNYGMNWVKQAPGKGLKWMGWINTYTGEPSYAAPFKGRFAFSLETSASTAYLQISSLKTEDTATYFCARGAYYRYDLGMDYWGQGTSVTVSS

SEQ ID NO: 4882 - protein, 121 aa, Artificial Sequence
  Description of Artificial Sequence: Synthetic polypeptide
ELQLVQSGGELKKPGETVRISCAASGYSFTNYGMNWVKQAPGKGLKWMGWINTYTGEPSYAAPFKGRFAFSLETSASTAYLQISSLKTEDTATYFCARGAYYRYDLGMDYWGQGTSVTVSS

SEQ ID NO: 4883 - protein, 445 aa, Artificial Sequence
  Description of Artificial Sequence: Synthetic polypeptide
QIQLVQSGPELKKPGETVKISCKASGYKFTNVGMNWVKQVPGKGLKWMGWINTYTGEPAYADDFKGRFVFSLETSASAAFLQINNLKNEDTATYFCARGAYYRYDLGMDYWGQGTSVTVSSAKTTPPSVYPLAPGSAAQTNSMVTLGCLVKGYFPEPVTVTWNSGSLSSGVHTFPAVLESDLYTLSSSVTVPSSMRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 4884 - protein, 121 aa, Artificial Sequence
  Description of Artificial Sequence: Synthetic polypeptide
QIQLVQSGPELKKPGETVKISCKASGYKFTNVGMNWVKQVPGKGLKWMGWINTYTGEPAYADDFKGRFVFSLETSASAAFLQINNLKNEDTATYFCARGAYYRYDLGMDYWGQGTSVTVSS

SEQ ID NO: 4885 - protein, 451 aa, Artificial Sequence
  Description of Artificial Sequence: Synthetic polypeptide
ELQLVQSGGELKKPGETVRISCAASGYSFTNYGMNWVKQAPGKGLKWMGWINTYTGEPSYAAPFKGRFAFSLETSASTAYLQISSLKTEDTATYFCARGAYYRYDLGMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4886 - protein, 449 aa, Artificial Sequence
  Description of Artificial Sequence: Synthetic polypeptide
EVQVEESGGGLVQPGGSMRLSCVASGFSFNNYWMNWVRQSPGKGLEWVAEIRLKSNNYATHYVDSVKGRFTISRDDSKSSVYLQMNNLRAEDTGIYYCTGWDDYAMDHWGQGISVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4887 - protein, 119 aa, Artificial Sequence
  Description of Artificial Sequence: Synthetic polypeptide
EVQVEESGGGLVQPGGSMRLSCVASGFSFNNYWMNWVRQSPGKGLEWVAEIRLKSNNYATHYVDSVKGRFTISRDDSKSSVYLQMNNLRAEDTGIYYCTGWDDYAMDHWGQGISVTVSS

SEQ ID NO: 4888 - protein, 449 aa, Artificial Sequence
  Description of Artificial Sequence: Synthetic polypeptide
EVKVEESGGGLVKTGGSMKLSCVASGFSFNNYWMNWVRQSPEKGLEWVAEIRLKSNNYATHYVESVKGRFTISRDDSKSSVYLQMNNLRAEDTGIYYCTGWDDYAMDHWGQGISVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 4889 - protein, 446 aa, Artificial Sequence
  Description of Artificial Sequence: Synthetic polypeptide
QVQLQQSGAELARPGASVKLSCKASGYTFTSYWMHWVKQRPGQGLEWIGAIYPGDGDTRYTQKFKGKATLTADKSSYTAYMQLSSLASEDSAVYYCARSPDFYGSGYDFDYWGQGTTLTVSSAKTTPPSVYPLAPGSAAQTNSMVTLGCLVKGYFPEPVTVTWNSGSLSSGVHTFPAVLESDLYTLSSSVTVPSSMRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 4890 - protein, 119 aa, Artificial Sequence
  Description of Artificial Sequence: Synthetic polypeptide
EVKVEESGGGLVKTGGSMKLSCVASGFSFNNYWMNWVRQSPEKGLEWVAEIRLKSNNYATHYVESVKGRFTISRDDSKSSVYLQMNNLRAEDTGIYYCTGWDDYAMDHWGQGISVTVSS

SEQ ID NO: 4891 - protein, 122 aa, Artificial Sequence
  Description of Artificial Sequence: Synthetic polypeptide
QVQLQQSGAELARPGASVKLSCKASGYTFTSYWMHWVKQRPGQGLEWIGAIYPGDGDTRYTQKFKGKATLTADKSSYTAYMQLSSLASEDSAVYYCARSPDFYGSGYDFDYWGQGTTLTVSS

SEQ ID NO: 4892 - protein, 448 aa, Artificial Sequence
  Description of Artificial Sequence: Synthetic polypeptide
QAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4893 - protein, 469 aa, Artificial Sequence
  Description of Artificial Sequence: Synthetic polypeptide
MEFGLSWVFLVAILRGVQCQVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPASKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4894 - protein, 469 aa, Artificial Sequence; identical to SEQ ID NO: 4861
  Description of Artificial Sequence: Synthetic polypeptide

SEQ ID NO: 4895 - protein, 474 aa, Artificial Sequence
  Description of Artificial Sequence: Synthetic polypeptide
MGSTAILALLLAVLQGVCAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGTAAGRDYYYYYGMDVWGQGTTVTVSSASTKGPSVFPLAPASKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4896 - protein, 474 aa, Artificial Sequence
  Description of Artificial Sequence: Synthetic polypeptide
MGSTAILALLLAVLQGVCAEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGTAAGRDYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4897 - protein, 442 aa, Artificial Sequence
  Description of Artificial Sequence: Synthetic polypeptide
QVQLQQSGSELKKPGASVKISCKASGYSFTDYIILWVRQNPGKGLEWIGHIDPYYGSSNYNLKFKGRVTITADQSTTTAYMELSSLRSEDTAVYYCGRSKRDYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4898 - protein, 467 aa, Artificial Sequence
  Description of Artificial Sequence: Synthetic polypeptide
MDFGFSLVFLALILKGVQCEVQLVQSGAEVKKPGASVKVSCKASGYRFTNYWIHWVRQAPGQGLEWIGGINPGNNYATYRRKFQGRVTMTADTSTSTVYMELSSLRSEDTAVYYCTREGYGNYGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4899 - protein, 450 aa, Artificial Sequence
  Description of Artificial Sequence: Synthetic polypeptide
EVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4900 - protein, 80 aa, Artificial Sequence
  Description of Artificial Sequence: Synthetic polypeptide
QVQLVQSGAEVKKPGASVKVSCKASGYTFTWVRQAPGQGLEWMGKFQGRVTMTRDTSTSTVYMELSSLRSEDTAVYYCAR

SEQ ID NO: 4901 - protein, 121 aa, Artificial Sequence
  Description of Artificial Sequence: Synthetic polypeptide
EVQLVQSGAEVKKPGASVKVSCKASGYRFTNYWIHWVRQAPGQGLEWIGGINPGNNYATYRRNLKGRATLTADTSTSTVYMELSSLRSEDTAVYYCTREGYGNYGAWFAYWGQGTLVTVSS

SEQ ID NO: 4902 - protein, 121 aa, Artificial Sequence
  Description of Artificial Sequence: Synthetic polypeptide
EVQLVQSGAEVKKPGASVKVSCKASGYRFTNYWIHWVRQAPGQGLEWIGGINPGNNYATYRRNLKGRVTMTADTSTSTVYMELSSLRSEDTAVYYCTREGYGNYGAWFAYWGQGTLVTVSS

SEQ ID NO: 4903 - protein, 121 aa, Artificial Sequence
  Description of Artificial Sequence: Synthetic polypeptide
EVQLVQSGAEVKKPGASVKVSCKASGYRFTNYWIHWVRQAPGQGLEWIGGINPGNNYATYRRKFQGRATLTADTSTSTVYMELSSLRSEDTAVYYCTREGYGNYGAWFAYWGQGTLVTVSS

SEQ ID NO: 4904 - protein, 121 aa, Artificial Sequence
  Description of Artificial Sequence: Synthetic polypeptide
EVQLVQSGAEVKKPGASVKVSCKASGYRFTNYWIHWVRQAPGQGLEWIGGINPGNNYATYRRKFQGRVTMTADTSTSTVYMELSSLRSEDTAVYYCTREGYGNYGAWFAYWGQGTLVTVSS

SEQ ID NO: 4905 - protein, 467 aa, Artificial Sequence; identical to SEQ ID NO: 4898
  Description of Artificial Sequence: Synthetic polypeptide

SEQ ID NO: 4906 - protein, 476 aa, Artificial Sequence
  Description of Artificial Sequence: Synthetic polypeptide
MEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSAKASGGPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 4907 - protein, 448 aa, Artificial Sequence
  Description of Artificial Sequence: Synthetic polypeptide
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4908 - protein, 454 aa, Artificial Sequence
  Description of Artificial Sequence: Synthetic polypeptide
QVQLQESGPGLVRPSQTLSLTCTASGYTFTDYVIHWVKQPPGRGLEWIGYINPYDDDTTYNQKFKGRVTMLVDTSSNTAYLRLSSVTAEDTAVYYCARRGNSYDGYFDYSMDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGFFFLYSKLTVDKSRWQQGNVFSCSVMHEALHNHYTQKSLSLSPGK

SEQ ID NO: 4909 - protein, 452 aa, Artificial Sequence
  Description of Artificial Sequence: Synthetic polypeptide
QVQLVESGGGVVQPGRSLRLSCAASGFTFSSYDMHWVRQAPGKGLEWVAVIWYDGSNKYYADSVKGRFTISRDNSKNTLYLQMNSLRAEDTAVYYCARGSGNWGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSS

SEQ ID NO: 4910 - protein, 450 aa, Artificial Sequence
  Description of Artificial Sequence: Synthetic polypeptide
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4911 - protein, 446 aa, Artificial Sequence
  Description of Artificial Sequence: Synthetic polypeptide
QVQLVQSGAEVKKPGASVKVSCKASGYTFTSYYIHWVRQAPGQGLEWIGCIYPGNVNTNYNEKFKDRATLTVDTSISTAYMELSRLRSDDTAVYFCTRSHYGLDWNFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4912 - protein, 446 aa, Artificial Sequence
  Description of Artificial Sequence: Synthetic polypeptide
AVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4913 - protein, 446 aa, Artificial Sequence
  Description of Artificial Sequence: Synthetic polypeptide
AVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4914 - protein, 446 aa, Artificial Sequence
  Description of Artificial Sequence: Synthetic polypeptide
AVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4915 - protein, 446 aa, Artificial Sequence
  Description of Artificial Sequence: Synthetic polypeptide
AVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLAGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4916 - protein, 483 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4917 - protein, 443 aa, Artificial Sequence
  Description of Artificial Sequence: Synthetic polypeptide
EIQLQQSGPELVKPGASVKVSCKASGYSFTDYNMYWVKQSHGKSLEWIGYIDPYNGDTTYNQKFKGKATLTVDKSSSTAFIHLNSLTSEDSAVYYCARSPYGHYAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 4918 - protein, 444 aa, Artificial Sequence
  Description of Artificial Sequence: Synthetic polypeptide
QVQVQESGPGLVAPSQTLSITCTVSGFSLTTSGVSWVRQPPGKGLEWLGVIWGDGSTNYHPSLKSRLSIKKDHSKSQVFLKLNSLTAADTATYYCAKGGYSLAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4919 - protein, 444 aa, Artificial Sequence
  Description of Artificial Sequence: Synthetic polypeptide
QVQVQESGPGLVAPSQTLSITCTVSGFSLTTSGVSWVRQPPGKGLEWLGVIWGDGSTNYHSSLKSRLSIKKDHSKSQVFLKLNSLTAADTATYYCAKGGYSLAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4920 - protein, 452 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4921 - protein, 450 aa, Artificial Sequence
  Description of Artificial Sequence: Synthetic polypeptide
QVQLVQSGAEVAKPGTSVKLSCKASGYTFTDYWMQWVKQRPGQGLEWIGTIYPGDGDTGYAQKFQGKATLTADKSSKTVYMHLSSLASEDSAVYYCARGDYYGSNSLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4922 - protein, 452 aa, Artificial Sequence; identical to SEQ ID NO: 4920
  Description of Artificial Sequence: Synthetic polypeptide

SEQ ID NO: 4923 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPASKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4924 - protein, 444 aa, Artificial Sequence
  Description of Artificial Sequence: Synthetic polypeptide
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4925 - protein, 463 aa, Artificial Sequence
  Description of Artificial Sequence: Synthetic polypeptide
MGWSCIILFLVATATGVHSEVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4926 - protein, 469 aa, Artificial Sequence; identical to SEQ ID NO: 4893
  Description of Artificial Sequence: Synthetic polypeptide

SEQ ID NO: 4927 - protein, 469 aa, Artificial Sequence; identical to SEQ ID NO: 4861
  Description of Artificial Sequence: Synthetic polypeptide

SEQ ID NO: 4928 - protein, 469 aa, Artificial Sequence; identical to SEQ ID NO: 4893
  Description of Artificial Sequence: Synthetic polypeptide

SEQ ID NO: 4929 - protein, 469 aa, Artificial Sequence; identical to SEQ ID NO: 4861
  Description of Artificial Sequence: Synthetic polypeptide

SEQ ID NO: 4930 - protein, 213 aa, Artificial Sequence
  Description of Artificial Sequence: Synthetic polypeptide
EIVLTQSPATLSLSPGERATLSCSASSSINYIYWYQQKPGQAPRLLIYLTSNLASGVPARFSGSGSGTDFTLTISSLEPEDFAVYYCLQWSSNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4931 - protein, 447 aa, Artificial Sequence
  Description of Artificial Sequence: Synthetic polypeptide
QVQLQQSGGELAKPGASVKVSCKASGYTFSSFWMHWVRQAPGQGLEWIGYINPRSGYTEYNEIFRDKATMTTDTSTSTAYMELSSLRSEDTAVYYCASFLGRGAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSSDKTHTCPPCPAPPVAGPSVFLFPPKPKDTLMISRTPEVTCVVVDVSHEDPEVQFNWYVDGVEVHNAKTKPREEQAQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4932 - protein, 233 aa, Artificial Sequence
  Description of Artificial Sequence: Synthetic polypeptide
MGWSCIILFLVATATGVHSDIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4933 - protein, 464 aa, Artificial Sequence
  Description of Artificial Sequence: Synthetic polypeptide
MEAPAQLLFLLLLWLPDTTGEVQLVESGGGLVQPGGSLRLSCAASGFTFNTYWMNWVRQAPGKGLEWVGQIRLKSNNYATHYAESVKGRFTISRDDSKNSLYLQMNSLKTEDTAVYYCTPVDFWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4934 - protein, 467 aa, Artificial Sequence
  Description of Artificial Sequence: Synthetic polypeptide
MEAPAQLLFLLLLWLPDTTGEVQLVESGGGLVQPGGSLRLSCAASGFTFTDYYMSWVRQAPGKGLEWVGFIRNKANGYTTEYNASVKGRFTISRDDSKNSLYLQMNSLKTEDTAVYYCTRYIFFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4935 - protein, 464 aa, Artificial Sequence
  Description of Artificial Sequence: Synthetic polypeptide
MEAPAQLLFLLLLWLPDTTGEVQLLESGGGLVQPGGSLRLSCAASGFTFSDAWMDWVRQAPGKGLELVSEIRNKAKNHATYYAESVKGRFTISRDNSKNTLYLQMNSLRAEDTAVYYCTTLDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4936 - protein, 464 aa, Artificial Sequence
  Description of Artificial Sequence: Synthetic polypeptide
MEAPAQLLFLLLLWLPDTTGEVQLLESGGGLVQPGGSLRLSCAASGFTFSDAWMDWVRQAPGKGLELVAEIRNKAKNHATYYAESVKGRFTISRDNSKNTLYLQMNSLRAEDTAVYYCTTLDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4937 - protein, 464 aa, Artificial Sequence
  Description of Artificial Sequence: Synthetic polypeptide
MEAPAQLLFLLLLWLPDTTGEVQLVESGGGLVQPGGSLRLSCAASGFPFSNYWMNWVRQAPGKGLEWVGQIRLKSNNYATHYAESVKGRFTISRDDSKNSLYLQMNSLKTEDTAVYYCTPIDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4938 - protein, 467 aa, Artificial Sequence
  Description of Artificial Sequence: Synthetic polypeptide
MEAPAQLLFLLLLWLPDTTGEVQLVESGGGLVQPGGSLRLSCAASGFTFSDYYMSWVRQAPGKGLEWVGFIRNKANGYTTEYSASVKGRFTISRDDSKNSLYLQMNSLKTEDTAVYYCARYIWFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4939 - protein, 448 aa, Artificial Sequence
  Description of Artificial Sequence: Synthetic polypeptide
QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4940 - protein, 450 aa, Artificial Sequence
  Description of Artificial Sequence: Synthetic polypeptide
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4941 - protein, 447 aa, Artificial Sequence
  Description of Artificial Sequence: Synthetic polypeptide
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4942 - protein, 119 aa, Artificial Sequence
  Description of Artificial Sequence: Synthetic polypeptide
QVQLVESGGGVVQPGRSLRLSCAASGFTFSSYVLHWVRQAPGKGLDWVAVISDDGRNKYFADSVKGRFTISRDNSKNTLYLQMNSLRAEDTAVYYCVREGYSGSWFDYWGQGTLVTVSS

SEQ ID NO: 4943 - protein, 119 aa, Artificial Sequence
  Description of Artificial Sequence: Synthetic polypeptide
QVQLVESGGGVVQPGRSLRLSCAASGFTFSSYAMHWVRQAPGKGLEWVAVISYDGRNKDYADSVKGRFTISRDNSKNTLYLQMNSLRAEDTAVHYCARLDWGYDAFDIWGQGTMVTVSS

SEQ ID NO: 4944 - protein, 449 aa, Artificial Sequence
  Description of Artificial Sequence: Synthetic polypeptide
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4945 - protein, 446 aa, Artificial Sequence
  Description of Artificial Sequence: Synthetic polypeptide
QVQLVQSGAEVKKPGASVKVSCKASGYTFTSYDISWVRQAPGQGLEWMGVIWTDGGTNYAQKLQGRVTMTTDTSTSTAYMELRSLRSDDTAVYYCARDQRLYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4946 - protein, 451 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4947 - protein, 451 aa, Artificial Sequence
  Description of Artificial Sequence: Synthetic polypeptide
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 4948 - protein, 447 aa, Artificial Sequence
  Description of Artificial Sequence: Synthetic polypeptide
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4949 - protein, 444 aa, Artificial Sequence
  Description of Artificial Sequence: Synthetic polypeptide
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 4950 - protein, 452 aa, Artificial Sequence
  Description of Artificial Sequence: Synthetic polypeptide
QVQLVESGGGVVQPGRSLRLSCAASGFTFSSYGMHWVRQAPGKGLEWVSFLWYDGTNKNYVESVKGRFTISRDNSKNMLYLEMNSLRAEDTAVYYCARDHDFRSGYEGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4951 - protein, 450 aa, Artificial Sequence
  Description of Artificial Sequence: Synthetic polypeptide
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4952 - protein, 453 aa, Artificial Sequence
  Description of Artificial Sequence: Synthetic polypeptide
EVQLVESGGGLVQPGGSLRLSCAASGYTFIDYYMNWVRQAPGKGLEWVGDINLDNSGTHYNQKFKGRFTISRDKSKNTAYLQMNSLRAEDTAVYYCAREGVYHDYDDYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4953 - protein, 449 aa, Artificial Sequence
  Description of Artificial Sequence: Synthetic polypeptide
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4954 - protein, 451 aa, Artificial Sequence
  Description of Artificial Sequence: Synthetic polypeptide
QVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSASTKGPSVLPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4955 - protein, 124 aa, Artificial Sequence
  Description of Artificial Sequence: Synthetic polypeptide
RAEVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVS

SEQ ID NO: 4956 - protein, 448 aa, Artificial Sequence
  Description of Artificial Sequence: Synthetic polypeptide
QVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4957 - protein, 225 aa, Artificial Sequence
  Description of Artificial Sequence: Synthetic polypeptide
HHHHHHEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4958 - protein, 457 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4959 - protein, 448 aa, Artificial Sequence
  Description of Artificial Sequence: Synthetic polypeptide
QVQLVQSGAEVKKPGASVKVSCKASGYTFTGYWMNWVRQAPGQGLEWMGDIYPGSGNTNYDEKFQGRVTMTRDTSISTAYMELSRLRSDDTAVYYCARGGYYEDFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4960 - protein, 450 aa, Artificial Sequence
  Description of Artificial Sequence: Synthetic polypeptide
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSRDELTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 4961 - protein, 448 aa, Artificial Sequence
  Description of Artificial Sequence: Synthetic polypeptide
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4962 - protein, 447 aa, Artificial Sequence
  Description of Artificial Sequence: Synthetic polypeptide
EVQLLESGGGLVQPGGSLRLSCAASGFTFSSYAMSWVRQAPGKGLEWVSAINSQGKSTYYADSVKGRFTISRDNSKNTLYLQMNSLRAEDTAVYYCARWGDEGFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4963 - protein, 445 aa, Artificial Sequence
  Description of Artificial Sequence: Synthetic polypeptide
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4964 - protein, 451 aa, Artificial Sequence
  Description of Artificial Sequence: Synthetic polypeptide
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESRVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4965 - protein, 449 aa, Artificial Sequence
  Description of Artificial Sequence: Synthetic polypeptide
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4966 - protein, 445 aa, Artificial Sequence
  Description of Artificial Sequence: Synthetic polypeptide
QVQLQQSGAELVKPGASVKLSCKASGYTFTSYDINWVRQRPEQGLEWIGWIFPGDGSTKYNEKFKGKATLTTDKSSSTAYMQLSRLTSEDSAVYFCAREDYYDNSYYFDYWGQGTTLTVSSAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 4967 - protein, 448 aa, Artificial Sequence
  Description of Artificial Sequence: Synthetic polypeptide
EVQLLESGGGLVQPGGSLRLSCAASGFTFSNYAMSWVRQAPGKGLEWVSSISGSGDYTYYTDSVKGRFTISRDNSKNTLYLQMNSLRAEDTAVYYCARSPWGYYLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4968 - protein, 456 aa, Artificial Sequence
  Description of Artificial Sequence: Synthetic polypeptide
METGLRWLLLVAVLKGVQCQSVEESGGRLVTPGTPLTLTCKASGFSLSDSRVSWVRQAPGKGLEWIGIVGIGWNIYHANWAKGRFTISKTSSTTVDLKITSPTVEDTATYFCARGLGGGTVIWGPGTLVTVSLGQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPTCPPPELLGGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPAVLDSDGSYFLYSKLSVPTSEWQRGDVFTCSVMHEALHNHYTQKSISRSPGK

SEQ ID NO: 4969 - protein, 458 aa, Artificial Sequence
  Description of Artificial Sequence: Synthetic polypeptide
METGLRWLLLVAVLKGVQCQSLEESGGRLVTPGTPLTLTCTVSGFSLSRNAINWVRQAPGKGLEYIGIIGSSGVTYYASWAKGRFTISRTSTTVDLKITSPTTEDTATYFCARNLYTGGSNDNLWGPGTLVTVSSGQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPTCPPPELLGGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPAVLDSDGSYFLYSKLSVPTSEWQRGDVFTCSVMHEALHNHYTQKSISRSPGK

SEQ ID NO: 4970 - protein, 214 aa, Artificial Sequence
  Description of Artificial Sequence: Synthetic polypeptide
VKLQESGPELVKPGASVKISCKASGYAFSRSWMNWVKQRPGQGLEWIGRIHPGDGDTNYNGKFKGKATLTVAKSSSTAYMQLSSLTSVDSAVYFCANEGSPYFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKLE

SEQ ID NO: 4971 - protein, 218 aa, Artificial Sequence
  Description of Artificial Sequence: Synthetic polypeptide
  MOD_RES (2)..(2): Any amino acid
VXLQQSGAELVRPGVSVKISCKGSGYTFTDYAMHWVKQSHAKSLEWIGVITNYYGDASYNQKFKGKATMTVDKSSSTAYMELARLTSEDSAIYYCARGGYDGYYVDFDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKLE

SEQ ID NO: 4972 - protein, 451 aa, Artificial Sequence
  Description of Artificial Sequence: Synthetic polypeptide
QVQLVQSGAEVKKPGASVKVSCKASGYTFTNYWIHWVRQAPGQGLEWIGVIDPSDTYPNYNKKFKGRVTMTVDTSTSTAYMELRSLRSDDTAVYYCARNGDSDYYSGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLLPPKPKDTLMISRTPEVTCVVVDVSHEDPEVKFNWYVDGVEVHNAKTKPPEEQYNSTLRVVSILTVLHQDWLNGKEYKCKVSNKALPAPIEKTISKAKGQPREPQVYTLPPSRDELTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 4973 - protein, 120 aa, Artificial Sequence
  Description of Artificial Sequence: Synthetic polypeptide
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 4974 - protein, 120 aa, Artificial Sequence [sequence omitted]

SEQ ID NO: 4975 - protein, 451 aa, Artificial Sequence
  Description of Artificial Sequence: Synthetic polypeptide
QVQLVQSGAEVKKPGASVKVSCKASGYTFTNYWIHWVRQAPGQGLEWIGVIDPSDTYPNYNKKFKGRVTMTVVVSTSTAYMELRSLRSDDTAVYYCARNGDSDYYSGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLLPPKPKDTLMISRTPEVTCVVVDVSHEDPEVKFNWYVDGVEVHNAKTKPPEEQYNSTLRVVSILTVLHQDWLNGKEYKCKVSNKALPAPIEKTISKAKGQPREPQVYTLPPSRDELTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 4976 - protein, 451 aa, Artificial Sequence; identical to SEQ ID NO: 4972
  Description of Artificial Sequence: Synthetic polypeptide

SEQ ID NO: 4977 - protein, 456 aa, Artificial Sequence
  Description of Artificial Sequence: Synthetic polypeptide
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4978 - protein, 447 aa, Artificial Sequence
  Description of Artificial Sequence: Synthetic polypeptide
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4979 - protein, 449 aa, Artificial Sequence
  Description of Artificial Sequence: Synthetic polypeptide
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4980 - protein, 443 aa, Artificial Sequence
  Description of Artificial Sequence: Synthetic polypeptide
EVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 4981 - protein, 113 aa, Artificial Sequence
  Description of Artificial Sequence: Synthetic polypeptide
EVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSS

SEQ ID NO: 4982 - protein, 445 aa, Artificial Sequence
  Description of Artificial Sequence: Synthetic polypeptide
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4983 - protein, 445 aa, Artificial Sequence
  Description of Artificial Sequence: Synthetic polypeptide
QVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 4984 - protein, 449 aa, Artificial Sequence
  Description of Artificial Sequence: Synthetic polypeptide
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4985 - protein, 447 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4986 - protein, 446 aa, Artificial Sequence
  Description of Artificial Sequence: Synthetic polypeptide
QSVEESGGRLVTPGTPLTLTCTVSGFSLSAYAMSWVRQAPEKGLEWIAVIYVIGATDYASWAKGRFTISRTSTTVDLRIPSPTTEDTATYFCARVYDSVWNHFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4987 - protein, 453 aa, Artificial Sequence
  Description of Artificial Sequence: Synthetic polypeptide
QSLEESGGDLVKPGGTLTLTCTASGFSFSDDHYMCWVRQAPGKGLQWIACMYVGSSGATYYASWAKGRFTISKTSSTTVTLQMTSLTAADTATYFCARDDWTSYYAWGYWALWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4988 - protein, 449 aa, Artificial Sequence
  Description of Artificial Sequence: Synthetic polypeptide
EVQLVESGGGLVQPGGSLRLSCAASGFTVSSNAISWVRQAPGKGLEWVGVIYVIGVTDYASSAQGRFTISRDNSKNTLYLQMNSLRAEDTAVYYCARVYDSGWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4989 - protein, 447 aa, Artificial Sequence
  Description of Artificial Sequence: Synthetic polypeptide
QSLEESGGRLVQPGTPLTLSCTASGLTISSYYMSWVRQAPGKGLEWVGTINPGANTYFASSAKGRFTISRSSTTLDLKMTSPTAEDTATYYCAREGDSNDWGVFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4990 - protein, 443 aa, Artificial Sequence
  Description of Artificial Sequence: Synthetic polypeptide
QSLEESGGRLVTPGTPLTLTCTVSGFSLNNYAVGWVRQAPGKGLEWIGIIYLSGNTDYANWAKGRFTISKTSTTVDLKITSPTTEDTATYFCARKFDTGYDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4991 - protein, 446 aa, Artificial Sequence
  Description of Artificial Sequence: Synthetic polypeptide
QSVEESGGRLVMPGTPLTLTCTVSGFSLSSNAISWVRQAPEKGLEWIGVIYVIGVTDYASWAQGRFTISKTSTTVDLKIPSPTTEDTATYFCARVYDSGWNHFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4992 - protein, 446 aa, Artificial Sequence; identical to SEQ ID NO: 4991
  Description of Artificial Sequence: Synthetic polypeptide

SEQ ID NO: 4993 - protein, 449 aa, Artificial Sequence
  Description of Artificial Sequence: Synthetic polypeptide
EVQLVESGGGLVQPGGSLRLSCAASGFTVSSNAISWVRQAPGKGLEWVGVIYVIGVTDYASSAQGRFTISRDNSKNTLYLQMNSLRAEDTAVYYCARVYDSGWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4994 - protein, 450 aa, Artificial Sequence
  Description of Artificial Sequence: Synthetic polypeptide
QSVEESGGRLVTPGTPLTLTCTVSGIDLNSNGMSWVRQAPGEGLEWIGASSIDGTTYYTNWAKGRFTISKTSSTTVDLKITSPTTEDTATYFCTRGEYAGVVGSNYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4995 - protein, 452 aa, Artificial Sequence
  Description of Artificial Sequence: Synthetic polypeptide
EVQLVESGGGLVQPGGSLRLSCAASGFTVSSNGMSWVRQAPGKGLEWVGASSIDGTTYYTNSAKGRFTISRDNSKNTLYLQMNSLRAEDTAVYYCARGEYAGVVGSNYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4996 - protein, 458 aa, Artificial Sequence
  Description of Artificial Sequence: Synthetic polypeptide
QSMEESGGRLVTPGTPLTLTCTVSGFSLSDYALSWVRQAPGKGLEWIGMISSGDNTYYASWAKGRFTISKASTTVDLKITSPTTEDTATYFCARDKDASSGGYLVLDLLDVPDGMDLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4997 - protein, 449 aa, Artificial Sequence
  Description of Artificial Sequence: Synthetic polypeptide
EVQLVESGGGLVQPGGSLRLSCAASGFTVSAYAMSWVRQAPGKGLEWVAVIYVIGATDYASSAKGRFTISRDNSKNTLYLQMNSLRAEDTAVYYCARVYDSVWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4998 - protein, 446 aa, Artificial Sequence
  Description of Artificial Sequence: Synthetic polypeptide
QSLEESGGRLVTPGGSLTLTCTVSGIDLSSNAISWVRQAPEKGLEWIAVIYVVGATDYASWAKGRFTISRTSTTVDLKMTSLTTEDTATYFCARVYDSGWNHFNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4999 - protein, 449 aa, Artificial Sequence
  Description of Artificial Sequence: Synthetic polypeptide
EVQLVESGGGLVQPGGSLRLSCAASGFTVSSNAISWVRQAPGKGLEWVAVIYVVGATDYASSAKGRFTISRDNSKNTLYLQMNSLRAEDTAVYYCARVYDSGWNHFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5000 - protein, 446 aa, Artificial Sequence
  Description of Artificial Sequence: Synthetic polypeptide
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5001 - protein, 446 aa, Artificial Sequence
  Description of Artificial Sequence: Synthetic polypeptide
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5002 - protein, 449 aa, Artificial Sequence
  Description of Artificial Sequence: Synthetic polypeptide
QSVEESGGRLVTPGTPLTLTCTVSGIDLSNYAMGWVRQAPGKGLEYIGMIGVNGRAWYATWAKGRFTISKTSPTVDLKITSPTTEDTATYFCARLIDERSTYSYVFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5003 - protein, 449 aa, Artificial Sequence
  Description of Artificial Sequence: Synthetic polypeptide
QSVEESGGRLVPPGTPLTLTCTVSGIDLSSYAMGWVRQAPGKGLEYIGMIDVSGSTYYADWAKGRLTISKTPTTVDLEITSPTTEDTATYFCARLIDERSTYSYAFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5004 - protein, 450 aa, Artificial Sequence
  Description of Artificial Sequence: Synthetic polypeptide
QSLEESGGRLVTPGTPLTLTCTASGFSLSSYDMSWVRQAPGKGLEWIGIIYAGSASTWFASWVKGRFTISKTSTTVDLKMTSLTTEDTATYFCARVGYSGYGYDDNLDMWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5005 - protein, 448 aa, Artificial Sequence
  Description of Artificial Sequence: Synthetic polypeptide
QSVEESGGRLVTPGTPLTLTCTASGFSLSNYWMGWVRQAPGEGLEWIGTISYDGNTYYASWAKGRFTISRTSTTVDLKMTSLTTEDTAIYFCATVNYPDYSTGAFNIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5006 - protein, 451 aa, Artificial Sequence
  Description of Artificial Sequence: Synthetic polypeptide
EVQLVESGGGLVQPGGSLRLSCAASGFTVSNYWMGWVRQAPGKGLEWIGTISYDGNTYYASSAKGRFTISRDNSKNTLYLQMNSLRAEDTAVYYCATVNYPDYSTGAFNIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5007 - protein, 447 aa, Artificial Sequence
  Description of Artificial Sequence: Synthetic polypeptide
QSVEESGGRLVTPGTPLTLTCTVSGFSLSTYYMSWVRQAPGKGLEWIGIIYVSGITDYARWAKGRFTISKTSTTVDLKMTSLTTEDTATYFCARHIDSSGWDGLGIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5008 - protein, 447 aa, Artificial Sequence
  Description of Artificial Sequence: Synthetic polypeptide
QSVEESGGRLVTPGTPLTLTCTVSGLTISSYYMSWVRQAPGKGLEWIGTINPGANTYFASWAKGRFTISRTSTTVDLKITSPTTEDTATYFCAREGDSNDWGVFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5009 - protein, 446 aa, Artificial Sequence
  Description of Artificial Sequence: Synthetic polypeptide
QSLEESGGRLVTPGTPLTLTCTASGFTIGRYYMSWVRQAPGKGLEWIGIIYTHGVNPDYASWAKGRFTISRPSTTVDLKITSPTTEDTATYFCARVGGFNDYSDIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5010 - protein, 449 aa, Artificial Sequence
  Description of Artificial Sequence: Synthetic polypeptide
EVQLVESGGGLVQPGGSLRLSCAASGFTVGRYYMSWVRQAPGKGLEWIGIIYTHGVNPDYASSAKGRFTISRDNSKNTLYLQMNSLRAEDTAVYYCARVGGFNDYSDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5011 - protein, 448 aa, Artificial Sequence
  Description of Artificial Sequence: Synthetic polypeptide
QSLEESGGRLVTPGTPLTLTCTASGFSLSSYAMGWFRQAPGKGLEWIAYIFASGSTYYASWAKGRFTISKTSTTVELKITSLTTEDTATYFCARGSGARFFPNYFAIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5012 - protein, 449 aa, Artificial Sequence
  Description of Artificial Sequence: Synthetic polypeptide
QSVEESGGRLVTPGTPLTLTCTVSGFSLSTYTMNWVRQAPGKGLEYIGFISSSSSIDYVSWAKGRFTISKTSTTVDLKITSPTTEDTATYFCARDFYADYIGGGYPYIWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5013 - protein, 448 aa, Artificial Sequence
  Description of Artificial Sequence: Synthetic polypeptide
QVQLVQPGAEVKKPGTSVKLSCKASGYTFTTYWMHWVRQAPGQGLEWIGEINPTNGHTNYNQKFQGRATLTVDKSTSTAYMELSSLRSEDTAVYYCARNYVGSIFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5014 - protein, 446 aa, Artificial Sequence
  Description of Artificial Sequence: Synthetic polypeptide
QVQLQESGPGLVKPSETLSLTCTVSGGSISIYYWSWIRQPPGKGLEWIGYVYYSGSTNYNPSLKSRVTISVDTSKNQFSLKLNSVTAADTAVYYCARGGYDFWSGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5015 - protein, 444 aa, Artificial Sequence
  Description of Artificial Sequence: Synthetic polypeptide
QVQLVQSGAEVKKPGSSVKVSCKASGYTFTDFYINWVRQAPGQGLEWIGEIYPYSGHAYYNEKFKARVTITADKSTSTAYMELSSLRSEDTAVYYCARWDFLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5016 - protein, 445 aa, Artificial Sequence
  Description of Artificial Sequence: Synthetic polypeptide
QVQLVQSGAEVKKPGASVKVSCKASGYTFTSYSISWVRQAPGQGLEWMGWISVYNGNTNYAQKFQGRVTMTTDTSTSTAYLELRSLRSDDTAVYYCARDPIAAGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5017 - protein, 450 aa, Artificial Sequence
  Description of Artificial Sequence: Synthetic polypeptide
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 5018 - protein, 448 aa, Artificial Sequence
  Description of Artificial Sequence: Synthetic polypeptide
EVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5019 - protein, 447 aa, Artificial Sequence
  Description of Artificial Sequence: Synthetic polypeptide
QVQLQQSGPGLVKPSQTLSLTCTVSGWSISGGWLWNWIRQPPGKGLQWIGWISWDGTNNWKPSLKDRVTISVDTSKNQFSLKLSSVTAADTAVWWCARWGRVFFDWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5020 - protein, 449 aa, Artificial Sequence
  Description of Artificial Sequence: Synthetic polypeptide
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5021 - protein, 149 aa, Artificial Sequence
  Description of Artificial Sequence: Synthetic polypeptide
MDWTWRILFLVAAATGAHSQVQLVQSGSELKKPGASVKVPCKASGYTFTSYAMNWVRQAPGQGLEWMGWINTNTGNPTYAQGFTGRFVFSLDTSVSTAYLQISSLKAEDTAVYYCAREVVPVAMRVTHYYYGMDVWGQGTTVTVSSAST

SEQ ID NO: 5022 - protein, 149 aa, Artificial Sequence
  Description of Artificial Sequence: Synthetic polypeptide
MDLMCKKMKHLWFFLLLVAAPRWVLSQLQLQESGPGLLKPSETLSLTCTVSGGSISSPGYYGGWIRQPPGKGLEWIGSIYKSGSTYHNPSLKSRVTISVDTSKNQFSLKLSSVTAADTAVYYCTRPVVRYFGWFDPWGQGTLVTVSSAS

SEQ ID NO: 5023 - protein, 474 aa, Artificial Sequence
  Description of Artificial Sequence: Synthetic polypeptide
MDLMCKKMKHLWFFLLLVAAPRWVLSQLQLQESGPGLLKPSETLSLTCTVSGGSISSPGYYGGWIRQPPGKGLEWIGSIYKSGSTYHNPSLKSRVTISVDTSKNQFSLKLSSVTAADTAVYYCTRPVVRYFGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5024 - protein, 412 aa, Artificial Sequence
  Description of Artificial Sequence: Synthetic polypeptide
GWIRQPPGKGLEWIGSIYKSGSTYHNPSLKSRVTISVDTSKNQFSLKLSSVTAADTAVYYCTRPVVRYFGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 5025 - protein, 143 aa, Artificial Sequence
  Description of Artificial Sequence: Synthetic polypeptide
MKHLWFFLLLVAAPRWVLSQVQLQESGPGLVKPSETLSLTCTVSGGSISGYYWSWIRQPPGKGLEWIGYIYYSGSTNYNPSLKSRVTISVDTSKNQFSLKLNSVTAADTAVYYCARAPLHGDYKWFHPWGQGTLVTVSSASTK

SEQ ID NO: 5026 - protein, 447 aa, Artificial Sequence
  Description of Artificial Sequence: Synthetic polypeptide
EVQLVESGGGLVQPGGSLRLSCAASGFTFSDYGIAWVRQAPGKGLEWVAFISDLAYTIYYADTVTGRFTISRDNSKNTLYLQMNSLRAEDTAVYYCARDNWDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5027 - protein, 445 aa, Artificial Sequence
  Description of Artificial Sequence: Synthetic polypeptide
QVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5028 - protein, 119 aa, Artificial Sequence
  Description of Artificial Sequence: Synthetic polypeptide
EVQLVESGGGVVQPGGSLRLSCAVSGFSLTTYGVHWVRQAPGKGLEWVAVIWSDGYTTYNSALKSRFTISRDNSKNTVYLQMNSLRAEDTAVYYCARNDGDYFYSMDYWGQGTLVTVSS

SEQ ID NO: 5029 - protein, 218 aa, Artificial Sequence
  Description of Artificial Sequence: Synthetic polypeptide
DVQMTQSPSSLSASVGDRVTITCRSSQSLVHSNGNTYLHWYQQKPGKAPKLLIYKVSNRFSGVPSRFSGSGSGTDFTLTISSLQPEDFATYYCSQSTHVPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5030 - protein, 447 aa, Artificial Sequence
  Description of Artificial Sequence: Synthetic polypeptide
EVQLVESGGGLVQPGGSLRLSCAASGFNFNDYFMNWVRQAPGKGLEWVAQMRNKNYQYGTYYAESLEGRFTISRDDSKNSLYLQMNSLKTEDTAVYYCARESYYGFTSYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5031 - protein, 443 aa, Artificial Sequence
  Description of Artificial Sequence: Synthetic polypeptide
VTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5032 - protein, 444 aa, Artificial Sequence
  Description of Artificial Sequence: Synthetic polypeptide
QVTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5033 - protein, 444 aa, Artificial Sequence
  Description of Artificial Sequence: Synthetic polypeptide
VTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5034 - protein, 445 aa, Artificial Sequence
  Description of Artificial Sequence: Synthetic polypeptide
QVTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5035 - protein, 448 aa, Artificial Sequence
  Description of Artificial Sequence: Synthetic polypeptide
EVQLVESGGGLVQPGGSLRLSCAASGFTFISYAMSWVRQAPGKGLEWVASISSGGNTYYPDSVKGRFTISRDNAKNSLYLQMNSLRAEDTAVYYCARLDGYYFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5036 - protein, 450 aa, Artificial Sequence
  Description of Artificial Sequence: Synthetic polypeptide
EVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARLWFGDLDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5037 - protein, 449 aa, Artificial Sequence
  Description of Artificial Sequence: Synthetic polypeptide
QVQLVQSGAEVKKPGASVKVSCKASGYTFTNYGLSWVRQAPGQGLEWMGWISANNGDTNYGQEFQGRVTMTTDTSTSTAYMELRSLRSDDTAVYYCARDSSSSWARWFFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5038 - protein, 453 aa, Artificial Sequence
  Description of Artificial Sequence: Synthetic polypeptide
EVQLVESGGGLVQPGRSLRLSCAASGFTFDDYAMHWVRQAPGKGLEWVSGINWSSGGIGYADSVKGRFTISRDNAKNSLYLQMNSLRAEDTALYYCARDIGGFGEFYWNFGLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5039 - protein, 445 aa, Artificial Sequence
  Description of Artificial Sequence: Synthetic polypeptide
QVQLVQSGAEVKKPGSSVKVSCKASGYSFTDYHIHWVRQAPGQGLEWMGVINPMYGTTDYNQRFKGRVTITADESTSTAYMELSSLRSEDTAVYYCARYDYFTGTGVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5040 - protein, 452 aa, Artificial Sequence
  Description of Artificial Sequence: Synthetic polypeptide
EVQLVESGGGLVQPGGSLRLSCAASGFTFSDYTMLWVRQAPGKGLEWVAIIKSGGSYSYYPDSVKGRFTISRDNAKNSLYLQMNSLRAEDTAVYYCARDGDYGSSYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5041 - protein, 457 aa, Artificial Sequence
  Description of Artificial Sequence: Synthetic polypeptide
EVQLVESGGGLVQPGGSLRLSCAASGFTFSNYWMNWVRQAPGKGLEWVAAINQDGSEKYYVGSVKGRFTISRDNAKNSLYLQMNSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5042 - protein, 461 aa, Artificial Sequence
  Description of Artificial Sequence: Synthetic polypeptide
MEWTWRVLFLVAAATGAHSQVQLVQSGAEVKKPGASVKVSCKASGYTFTRYGISWVRQAPGQGLEWMGWISTYSGNTNYAQKLQGRVTMTTDTSTSTAYMELRSLRSDDTAVYYCARRQLYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5043 - protein, 118 aa, Artificial Sequence
  Description of Artificial Sequence: Synthetic polypeptide
EVQLVQSGAEVKKPGESLKISCKGSGYSFTSYWIGWVRQMPGKGLEWMGIIYPSDSDTRYSPSFQGQVTISADKSISTAYLQWSSLKASDTAMYYCARYTNWDAFDIWGQGTMVTVSS

SEQ ID NO: 5044 - protein, 450 aa, Artificial Sequence
  Description of Artificial Sequence: Synthetic polypeptide
QVQLVQSGAEVKKPGASVKVSCKASGYTFTNYYMHWVRQAPGQGLEWVGWINPYTGSAFYAQKFRGRVTMTRDTSISTAYMELSRLRSDDTAVYYCAREPEKFDSDDSDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5045 - protein, 446 aa, Artificial Sequence
  Description of Artificial Sequence: Synthetic polypeptide
QVQLVQSGAEVKKPGASVKVSCKASGYIFITYWMTWVRQAPGQGLEWMGQIFPASGSADYNEKFEGRVTMTTDTSTSTAYMELRSLRSDDTAVYYCARGGGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5046 - protein, 445 aa, Artificial Sequence
  Description of Artificial Sequence: Synthetic polypeptide
QVQLVQSGAEVKKPGASVKVSCKASGYTFTGYIMNWVRQAPGQGLEWMGLINPYNGGTDYNPQFQDRVTITADKSTSTAYMELSSLRSEDTAVYYCARDGYDDGPYTLETWGQGTLVTVSSASTKGPSVFPLAPSSKSTSGGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSQEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESNGQPENNYKTTPPMLDSDGSFFLYSKLTVDKSRWQEGNVFSCSVMHEALHNHYTQKSLSLSP

SEQ ID NO: 5047 - protein, 451 aa, Artificial Sequence
  Description of Artificial Sequence: Synthetic polypeptide
EVQLVESGGGLEQPGGSLRLSCAGSGFTFRDYAMTWVRQAPGKGLEWVSSISGSGGNTYYADSVKGRFTISRDNSKNTLYLQMNSLRAEDTAVYYCAKDRLSITIRPRYYGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5048 - protein, 121 aa, Artificial Sequence [sequence omitted]

SEQ ID NO: 5049 - protein, 451 aa, Artificial Sequence
  Description of Artificial Sequence: Synthetic polypeptide
EVQLVQSGAEVKKPGASVKVSCKASGYTFTSYVIHWVRQRPGQGLAWMGYINPYNDGTKYNERFKGKVTITSDRSTSTVYMELSSLRSEDTAVYLCGREGIRYYGLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5050 - protein, 447 aa, Artificial Sequence; identical to SEQ ID NO: 5030
  Description of Artificial Sequence: Synthetic polypeptide

SEQ ID NO: 5051 - protein, 449 aa, Artificial Sequence
  Description of Artificial Sequence: Synthetic polypeptide
EVQLVESGGKLLKPGGSLKLSCAASGFTFSSFAMSWFRQSPEKRLEWVAEISSGGSYTYYPDTVTGRFTISRDNAKNTLYLEMSSLRSEDTAMYYCARGLWGYYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5052 - protein, 120 aa, Artificial Sequence
  Description of Artificial Sequence: Synthetic polypeptide
EVQILETGGGLVKPGGSLRLSCATSGFNFNDYFMNWVRQAPGKGLEWLAQMRNKNYQYGTYYAESLEGRVTVSRDDAKNSVYLQVSSLRAEDTAIYYCTRESYYGFTSYWGQGVMVTVSS

SEQ ID NO: 5053 - protein, 166 aa, Artificial Sequence
  Description of Artificial Sequence: Synthetic polypeptide
METGLRWLLLVAVLSGVQCQSLEESGGRLVTPGTPLTLTCTASGFSLSNYYMTWVRQAPGKGLEWIGMIYGSDETAYANWAIGRFTISKTSTTVDLKMTSLTAADTATYFCARDDSSDWDAKFNLWGQGTLVTVSSASTKGPSVFPLAPSSKSTSGGTAALGCLVK

SEQ ID NO: 5054 - protein, 109 aa, Artificial Sequence
  Description of Artificial Sequence: Synthetic polypeptide
EVQLVESGGGLVQPGGSLRLSCAASGFSLSNYYMTWVRQAPGKGLEWVGMIYGSDETAYANWAIGRFTISRDNSKNTLYLQMNSLRAEDTAVYYCARDDSSDWDAKFNL

SEQ ID NO: 5055 - protein, 109 aa, Artificial Sequence
  Description of Artificial Sequence: Synthetic polypeptide
EVQLVESGGGLVQPGGSLRLSCAASGFSLSNYYMTWVRQAPGKGLEWVGMIYGSDETAYANSAIGRFTISRDNSKNTLYLQMNSLRAEDTAVYYCARDDSSDWDAKFNL

SEQ ID NO: 5056 - protein, 128 aa, Artificial Sequence
  Description of Artificial Sequence: Synthetic polypeptide
METGLRWLLLVAVLKGVQCHSVEESGGRLVTPGTPLTLTCTVSGFSLSSRTMSWVRQAPGKGLEWIGYIWSGGSTYYATWAKGRFTISKTSTTVDLKITSPTTEDTATYFCARLGDTGGHAYATRLNL

SEQ ID NO: 5057 - protein, 126 aa, Artificial Sequence
  Description of Artificial Sequence: Synthetic polypeptide
METGLRWLLLVAVLKGVQCQSVEESGGRLVKPDETLTLTCTASGFSLEGGYMTWVRQAPGKGLEWIGISYDSGSTYYASWAKGRFTISKTSSTTVDLKMTSLTTEDTATYFCVRSLKYPTVTSDDL

SEQ ID NO: 5058 - protein, 128 aa, Artificial Sequence
  Description of Artificial Sequence: Synthetic polypeptide
METGLRWLLLVAVLKGVQCQSVEESGGRLVTPGTPLTLTCTVSGLSLSSNTINWVRQAPGKGLEWIGYIWSGGSTYYASWVNGRFTISKTSTTVDLKITSPTTEDTATYFCARGGYASGGYPYATRLD

SEQ ID NO: 5059 - protein, 123 aa, Artificial Sequence
  Description of Artificial Sequence: Synthetic polypeptide
METGLRWLLLVAVLKGVQCQSLEESGGRLVTPGTPLTLTCTVSGFTLSTNYYLSWVRQAPGKGLEWIGIIYPSGNTYCAKWAKGRFTISKTSSTTVDLKMTSPTTEDTATYFCARNYGGDESL

SEQ ID NO: 5060 - protein, 109 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATWAIGRFTISRDNSKNTLYLQMNSLRAEDTAVYYCARDDSSDWDAKFNL

SEQ ID NO: 5061 - protein, 128 aa, Artificial Sequence
  Description of Artificial Sequence: Synthetic polypeptide
METGLRWLLLVTVLKGVQCQEQLVESGGGLVQPEGSLTLTCTASGFDFSSGYYMCWVRQAPGKGLEWIACIFTITTNTYYASWAKGRFTISKTSSTTVTLQMTSLTAADTATYLCARGIYSDNNYYAL

SEQ ID NO: 5062 - protein, 109 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNL

SEQ ID NO: 5063 - protein, 128 aa, Artificial Sequence
  Description of Artificial Sequence: Synthetic polypeptide
METGLRWLLLVAVLKGVQCQQQLVESGGGLVKPGASLTLTCKASGFSFSSGYYMCWVRQAPGKGLESIACIFTITDNTYYANWAKGRFTISKPSSPTVTLQMTSLTAADTATYFCARGIYSTDNYYAL

SEQ ID NO: 5064 - protein, 133 aa, Artificial Sequence
  Description of Artificial Sequence: Synthetic polypeptide
METGLRWLLLVAVLKGVQCQSVEESGGRLVTPGTPLTLTCTVSGISLSSNAISWVRQAPGKGLEWIGIISYSGTTYYASWAKGRFTISKTSSTTVDLKITSPTTEDTATYFCARDDPTTVMVMLIPFGAGMDL

SEQ ID NO: 5065 - protein, 167 aa, Artificial Sequence
  Description of Artificial Sequence: Synthetic polypeptide
METGLRWLLLVAVLKGVQCQEQLKESGGRLVTPGTPLTLTCTASGFSLNDHAMGWVRQAPGKGLEYIGFINSGGSARYASWAEGRFTISRTSTTVDLKMTSLTTEDTATYFCVRGGAVWSIHSFDPWGPGTLVTVSSASTKGPSVFPLAPSSKSTSGGTAALGCLVK

SEQ ID NO: 5066 - protein, 119 aa, Artificial Sequence
  Description of Artificial Sequence: Synthetic polypeptide
METGLRWLLLVAVLKGVQCQSLEESGGDLVKPEGSLTLTCTASGFSFSSYWMCWVRQAPGKGLEWIACIVTGNGNTYYANWAKGRFTISKTSSTTVTLQMTSLTAADTATYFCAKAYDL

SEQ ID NO: 5067 - protein, 125 aa, Artificial Sequence
  Description of Artificial Sequence: Synthetic polypeptide
METGLRWLLLVAVPKGVQCQSLEESGGRLVTPGTPLTLTCTLSGFSLSAYYMSWVRQAPGKGLEWIGFITLSDHISYARWAKGRFTISKTSTTVDLKMTSPTTEDTATYFCARSRGWGAMGRLDL

SEQ ID NO: 5068 - protein, 121 aa, Artificial Sequence
  Description of Artificial Sequence: Synthetic polypeptide
METGLRWLLLVAVLKGVQCQSVEESGGRLVTPGTPLTLTCTASGFSLSSYSMTWVRQAPGKGLEYIGVIGTSGSTYYATWAKGRFTISRTSTTVALKITSPTTEDTATYFCVRSLSSITFL

SEQ ID NO: 5069 - protein, 128 aa, Artificial Sequence
  Description of Artificial Sequence: Synthetic polypeptide
METGLRWLLLVAVLKGVQCQEQLVESGGDLVQPEGSLTLTCTASELDFSSGYWICWVRQVPGKGLEWIGCIYTGSSGSTFYASWAKGRFTISKTSSTTVTLQMTSLTAADTATYFCARGYSGFGYFKL

SEQ ID NO: 5070 - protein, 123 aa, Artificial Sequence
  Description of Artificial Sequence: Synthetic polypeptide
METGLRWLLLVAVLKGVQCQSVEESGGRLVTPGTPLTLTCTASGFSLSSYYMSWVRQAPGKGLEWIGIITTSGNTFYASWAKGRLTISRTSTTVDLKITSPTTEDTATYFCARTSDIFYYRNL

SEQ ID NO: 5071 - protein, 166 aa, Artificial Sequence
  Description of Artificial Sequence: Synthetic polypeptide
METGLRWLLLVAVLKGVQCQSLEESGGRLVTPGTPLTLTCTASGFSLSNYYVTWVRQAPGKGLEWIGIIYGSDETAYATWAIGRFTISKTSTTVDLKMTSLTAADTATYFCARDDSSDWDAKFNLWGQGTLVTVSSASTKGPSVFPLAPSSKSTSGGTAALGCLVK

SEQ ID NO: 5072 - protein, 129 aa, Artificial Sequence
  Description of Artificial Sequence: Synthetic polypeptide
METGLRWLLLVAVLKGVQCQSVEESGGRLVTPGTPLTLTCTVSGFSLTRHAITWVRQAPGKGLEWIGCIWSGGSTYYATWAKGRFTISKTSTTVDLRITSPTTEDTATYFCARVIGDTAGYAYFTGLDL

SEQ ID NO: 5073 - protein, 128 aa, Artificial Sequence
  Description of Artificial Sequence: Synthetic polypeptide
METGLRWLLLVAVLKGVQCQSLEEAGGRLVTPGTPLTLTCTVSGIDLSSYAMGWVRQAPGKGLEYIGIISSSGSTYYATWAKGRFTISQASSTTVDLKITSPTTEDSATYFCARGGAGSGGVWLLDGF

SEQ ID NO: 5074 - protein, 128 aa, Artificial Sequence
  Description of Artificial Sequence: Synthetic polypeptide
METGLRWLLLVAVLKGVQCQEQLKESGGRLVTPGTPLTLTCTVSGFSLNDYAVGWFRQAPGKGLEWIGYIRSSGTTAYATWAKGRFTISATSTTVDLKITSPTTEDTATYFCARGGAGSSGVWILDGF

SEQ ID NO: 5075 - protein, 128 aa, Artificial Sequence
  Description of Artificial Sequence: Synthetic polypeptide
METGLRWLLLVAVLKGVQCQSLEESGGDLVKPGASLTLTCTASGFSFTSTYYIYWVRQAPGKGLEWIACIDAGSSGSTYYATWVNGRFTISKTSSTTVTLQMTSLTAADTATYFCAKWDYGGNVGWGY

SEQ ID NO: 5076 - protein, 127 aa, Artificial Sequence
  Description of Artificial Sequence: Synthetic polypeptide
METGLRWLLLVAVLKGVQCQSLEESGGDLVKPEGSLTLTCKASGLDLGTYWFMCWVRQAPGKGLEWIACIYTGSSGSTFYASWVNGRFTISKTSSTTVTLQMTSLTAADTATYFCARGYSGYGYFKL

SEQ ID NO: 5077 - protein, 166 aa, Artificial Sequence
  Description of Artificial Sequence: Synthetic polypeptide
METGLRWLLLVAVLKGVQCQSLEESGGRLVTPGTPLTLTCTASGFSLSVYYMNWVRQAPGKGLEWIGFITMSDNINYASWAKGRFTISKTSTTVDLKMTSPTTEDTATYFCARSRGWGTMGRLDLWGPGTLVTVSSASTKGPSVFPLAPSSKSTSGGTAALGCLVK

SEQ ID NO: 5078 - protein, 128 aa, Artificial Sequence
  Description of Artificial Sequence: Synthetic polypeptide
METGLRWLLLVAVLKGVQCQSLEESGGDLVKPGASLTLTCTTSGFSFSSSYFICWVRQAPGKGLEWIACIYGGDGSTYYASWAKGRFTISKTSSTTVTLQMTSLTAADTATYFCAREWAYSQGYFGAF

SEQ ID NO: 5079 - protein, 124 aa, Artificial Sequence
  Description of Artificial Sequence: Synthetic polypeptide
METGLRWLLLVAVLKGVQCQSVEESGGRLVTPGTPLTLTCTVSGFSLSSYFMTWVRQAPGEGLEYIGFINPGGSAYYASWVKGRFTISKSSTTVDLKITSPTTEDTATYFCARVLIVSYGAFTI

SEQ ID NO: 5080 - protein, 124 aa, Artificial Sequence
  Description of Artificial Sequence: Synthetic polypeptide
METGLRWLLLVAVLKGVQCQSVEESGGRLVTPGTPLTLTCTVSGFSLSSYFMTWVRQAPGEGLEYIGFMNTGDNAYYASWAKGRFTISKTSTTVDLKITSPTTEDTATYFCARVLVVAYGAFNI

SEQ ID NO: 5081 - protein, 127 aa, Artificial Sequence
  Description of Artificial Sequence: Synthetic polypeptide
METGLRWLLLVAVLKGVQCQSVEESGGRLVKPDETLTLTCTVSGIDLSSYPMNWVRQAPGKGLEWIGFINTGGTIVYASWAKGRFTISKTSTTVDLKMTSPTTEDTATYFCARGSYVSSGYAYYFNV

SEQ ID NO: 5082 - protein, 126 aa, Artificial Sequence
  Description of Artificial Sequence: Synthetic polypeptide
METGLRWLLLVAVLKGVQCQSVEESGGRLVTPGTPLTLTCTVSGFSLSTYSINWVRQAPGKGLEWIGIIANSGTTFYANWAKGRFTVSKTSTTVDLKITSPTTEDTATYFCARESGMYNEYGKFNI

SEQ ID NO: 5083 - protein, 128 aa, Artificial Sequence
  Description of Artificial Sequence: Synthetic polypeptide
METGLRWLLLVAVLKGVQCQSLEESGGRLVTPGTPLTLTCTVSGIDLSAYAMIWVRQAPGEGLEWITIIYPNGITYYANWAKGRFTVSKTSTAMDLKITSPTTEDTATYFCARDAESSKNAYWGYFNV

SEQ ID NO: 5084 - protein, 128 aa, Artificial Sequence; identical to SEQ ID NO: 5083
  Description of Artificial Sequence: Synthetic polypeptide

SEQ ID NO: 5085 - protein, 123 aa, Artificial Sequence
  Description of Artificial Sequence: Synthetic polypeptide
METGLRWLLLVAVLKGVQCQSLEESGGRLVTPGTPLTLTCTVSGFSLNRNSITWVRQAPGEGLEWIGIITGSGRTYYANWAKGRFTISKTSTTVDLKMTSPTTEDTATYFCARGHPGLGSGNI

SEQ ID NO: 5086 - protein, 122 aa, Artificial Sequence
  Description of Artificial Sequence: Synthetic polypeptide
METGLRWLLLVAVLKGVQCQSLEESGGRLVTPGTPLTLTCTASGFSLNNYYIQWVRQAPGEGLEWIGIIYAGGSAYYATWANGRFTIAKTSSTTVDLKMTSLTTEDTATYFCARGTFDGYEL

SEQ ID NO: 5087 - protein, 124 aa, Artificial Sequence
  Description of Artificial Sequence: Synthetic polypeptide
METGLRWLLLVAVLKGVQCQSVEESGGRLVTPGTPLTLTCTVSGFSLSSYFMSWVRQAPGEGLEYIGFINPGGSAYYASWASGRLTISKTSTTVDLKITSPTTEDTATYFCARILIVSYGAFTI

SEQ ID NO: 5088 - protein, 167 aa, Artificial Sequence
  Description of Artificial Sequence: Synthetic polypeptide
METGLRWLLLVAVLKGVQCQEQLKESGGGLVTPGGTLTLTCTASGFSLNAYYMNWVRQAPGKGLEWIGFITLNNNVAYANWAKGRFTFSKTSTTVDLKMTSPTPEDTATYFCARSRGWGAMGRLDLWGHGTLVTVSSASTKGPSVFPLAPSSKSTSGGTAALGCLVK

SEQ ID NO: 5089 - protein, 128 aa, Artificial Sequence
  Description of Artificial Sequence: Synthetic polypeptide
METGLRWLLLVAVLKGVQCQSLEESGGRLVTPGTPLTLTCTVSGFSLSKYYMSWVRQAPEKGLKYIGYIDSTTVNTYYATWARGRFTISKTSTTVDLKITSPTSEDTATYFCARGSTYFTDGGHRLDL

SEQ ID NO: 5090 - protein, 124 aa, Artificial Sequence
  Description of Artificial Sequence: Synthetic polypeptide
METGLRWLLLVAVLKGVQCQSLEESGGRLVTPGTPLTLTCTVSGFSLSTYNMGWVRQAPGKGLEWIGSITIDGRTYYASWAKGRFTVSKSSTTVDLKMTSLTTGDTATYFCARILIVSYGAFTI

SEQ ID NO: 5091 - protein, 117 aa, Artificial Sequence
  Description of Artificial Sequence: Synthetic polypeptide
QSLEESGGRLVTPGTPLTLTCTASGFSLSNYYVTWVRQAPGKGLEWIGIIYGSDETAYATWAIGRFTISKTSTTVDLKMTSLTAADTATYFCARDDSSDWDAKFNLWGQGTLVTVSS

SEQ ID NO: 5092 - protein, 97 aa, Artificial Sequence
  Description of Artificial Sequence: Synthetic polypeptide
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCAR

SEQ ID NO: 5093 - protein, 97 aa, Artificial Sequence
  Description of Artificial Sequence: Synthetic polypeptide
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCAR

SEQ ID NO: 5094 - protein, 98 aa, Artificial Sequence
  Description of Artificial Sequence: Synthetic polypeptide
EVQLLESGGGLVQPGGSLRLSCAASGFTFSSYAMSWVRQAPGKGLEWVSVIYSGGSSTYYADSVKGRFTISRDNSKNTLYLQMNSLRAEDTAVYYCAK

SEQ ID NO: 5095 - protein, 120 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATWAIGRFTISRDNSKNTLYLQMNSLRAEDTAVYYCARDDSSDWDAKFNLWGQGTLVTVSS

SEQ ID NO: 5096 - protein, 120 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNLWGQGTLVTVSS

SEQ ID NO: 5097 - protein, 166 aa, Artificial Sequence
  Description of Artificial Sequence: Synthetic polypeptide
METGLRWLLLVAVLKGVQCQSLEESGGRLVTPGTPLTLTCTASGFSLSNYYVTWVRQAPGKGLEWIGIIYGSDETAYATSAIGRFTISKTSTTVDLKMTSLTAADTATYFCARDDSSDWDAKFNLWGQGTLVTVSSASTKGPSVFPLAPSSKSTSGGTAALGCLVK

SEQ ID NO: 5098 - protein, 125 aa, Artificial Sequence
  Description of Artificial Sequence: Synthetic polypeptide
METGLRWLLLVAVLKGVQCQSLEESGGRLVTPGTPLTLTCTASGFSLSNYYVTWVRQAPGKGLEWIGIIYGSDETAYATWAIGRFTISKTSTTVDLKMTSLTAADTATYFCARDDSSDWDAKFNL

SEQ ID NO: 5099 - protein, 450 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATWAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5100 - protein, 450 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5101 - protein, 126 aa, Artificial Sequence
  Description of Artificial Sequence: Synthetic polypeptide
METGLRWLLLVAVLKGVQCQEQLKESGGRLVTPGTPLTLTCTASGFSLNDHAMGWVRQAPGKGLEYIGFINSGGSARYASWAEGRFTISRTSTTVDLKMTSLTTEDTATYFCVRGGAVWSIHSFDP

SEQ ID NO: 5102 - protein, 125 aa, Artificial Sequence
  Description of Artificial Sequence: Synthetic polypeptide
METGLRWLLLVAVLKGVQCQSLEESGGRLVTPGTPLTLTCTASGFSLSVYYMNWVRQAPGKGLEWIGFITMSDNINYASWAKGRFTISKTSTTVDLKMTSPTTEDTATYFCARSRGWGTMGRLDL

SEQ ID NO: 5103 - protein, 126 aa, Artificial Sequence
  Description of Artificial Sequence: Synthetic polypeptide
METGLRWLLLVAVLKGVQCQEQLKESGGGLVTPGGTLTLTCTASGFSLNAYYMNWVRQAPGKGLEWIGFITLNNNVAYANWAKGRFTFSKTSTTVDLKMTSPTPEDTATYFCARSRGWGAMGRLDL

SEQ ID NO: 5104 - protein, 122 aa, Artificial Sequence
  Description of Artificial Sequence: Synthetic polypeptide
METGLRWLLLVAVLKGVQCQSVEESGGRLVTPGTPLTLTCTVSGFSLSSYAMSWVRQAPGKGLEWIGIIGGFGTTYYATWAKGRFTISKTSTTVDLRITSPTTEDTATYFCARGGPGNGGDI

SEQ ID NO: 5105 - protein, 128 aa, Artificial Sequence
  Description of Artificial Sequence: Synthetic polypeptide
METGLRWLLLVAVLKGVQCQSVEESGGRLVTPGTPLTLTCTVSGIDLSDYAMSWVRQAPGKGLEWIGIIYAGSGSTWYASWAKGRFTISKTSTTVDLKITSPTTEDTATYFCARDGYDDYGDFDRLDL

SEQ ID NO: 5106 - protein, 125 aa, Artificial Sequence
  Description of Artificial Sequence: Synthetic polypeptide
METGLRWLLLVAVLSGVQCQSLEESGGRLVTPGTPLTLTCTASGFSLSNYYMTWVRQAPGKGLEWIGMIYGSDETAYANWAIGRFTISKTSTTVDLKMTSLTAADTATYFCARDDSSDWDAKFNL

SEQ ID NO: 5107 - protein, 450 aa, Artificial Sequence
  Description of Artificial Sequence: Synthetic polypeptide
EVQLVESGGGLVQPGGSLRLSCAASGFSLSNYYMTWVRQAPGKGLEWVGMIYGSDETAYANWAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5108 - protein, 450 aa, Artificial Sequence
  Description of Artificial Sequence: Synthetic polypeptide
EVQLVESGGGLVQPGGSLRLSCAASGFSLSNYYMTWVRQAPGKGLEWVGMIYGSDETAYANSAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5109 - protein, 164 aa, Artificial Sequence
  Description of Artificial Sequence: Synthetic polypeptide
METGLRWLLLVAVLKGVQCQSVEESGGRLVTPGTPLTLTCTVSGFSLSSYAMSWVRQAPGKGLEWIGIIGGFGTTYYATWAKGRFTISKTSTTVDLRITSPTTEDTATYFCARGGPGNGGDIWGQGTLVTVSSASTKGPSVFPLAPSSKSTSGGTAALGCLVKD

SEQ ID NO: 5110 - protein, 450 aa, Artificial Sequence
  Description of Artificial Sequence: Synthetic polypeptide
EVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5111 - protein, 468 aa, Artificial Sequence
  Description of Artificial Sequence: Synthetic polypeptide
MKWVTFISLLFLFSSAYSEVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5112 - protein, 170 aa, Artificial Sequence
  Description of Artificial Sequence: Synthetic polypeptide
METGLRWLLLVAVLKGVQCQSVEESGGRLVTPGTPLTLTCTVSGIDLSDYAMSWVRQAPGKGLEWIGIIYAGSGSTWYASWAKGRFTISKTSTTVDLKITSPTTEDTATYFCARDGYDDYGDFDRLDLWGPGTLVTVSSASTKGPSVFPLAPSSKSTSGGTAALGCLVKD

SEQ ID NO: 5113 - protein, 446 aa, Artificial Sequence
  Description of Artificial Sequence: Synthetic polypeptide
EVQLVESGGGLVQPGRSLRLSCAASRFTFDDYAMHWVRQAPGKGLEWVSGISWNSGRIGYADSVKGRFTISRDNAENSLFLQMNGLRAEDTALYYCAKGRDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5114 - protein, 117 aa, Artificial Sequence
  Description of Artificial Sequence: Synthetic polypeptide
QVNLRESGGGLVKPGGSLRLSCAASGFTFDDSVMHWVRQAPGKGLEWLSLVGWDGFFTYYADSVKGRFTISRDNTKNLLYLQMNSLRAEDTAVYYCARQGDYMGNNWGQGTLVTVSS

SEQ ID NO: 5115 - protein, 117 aa, Artificial Sequence; identical to SEQ ID NO: 5114
  Description of Artificial Sequence: Synthetic polypeptide

SEQ ID NO: 5116 - protein, 431 aa, Artificial Sequence
  Description of Artificial Sequence: Synthetic polypeptide
QVNLRESGGGLVKPGGSLRLSCAASGFTFDDSVMHWVRQAPGKGLEWLSLVGWDGFFTYYADSVKGRFTISRDNTKNLLYLQMNSLRAEDTAVYYCARQGDYMGNNWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5117 - protein, 117 aa, Artificial Sequence
  Description of Artificial Sequence: Synthetic polypeptide
QVNLRESGGGLVKPGGSLRLSCAASGFTFDDSVMHWVRQAPGKGLEWLSLVGWDGSATYYADSVKGRFTISRDNTKNLLYLQMNSLRAEDTAVYYCARQGDYVFDYWGQGTLVTVSS

SEQ ID NO: 5118 - protein, 118 aa, Artificial Sequence
  Description of Artificial Sequence: Synthetic polypeptide
QVTLKESGGGLVQPGGSLRLSCAASGFTFSNYGMHWVRQAPGKGLEWVSAISGSGGSTYYADSVKGRFTISRDNSKNTVYLQMNSLRDEDTAVYYCARDISGGGMDVWGQGTTVTVSS

SEQ ID NO: 5119 - protein, 117 aa, Artificial Sequence
  Description of Artificial Sequence: Synthetic polypeptide
EVQLVESGGGLVKPGGSLRLSCAASGFTFDDSVMHWVRQAPGKGLEWVSLVGWDGFFTYYADSVKGRFTISRDNAKNSLYLQMNSLRAEDTAVYYCARQGDYMGNNWGQGTLVTVSS

SEQ ID NO: 5120 - protein, 432 aa, Artificial Sequence
  Description of Artificial Sequence: Synthetic polypeptide
EVQLVESGGGLVKPGGSLRLSCAASGFTFDDSVMHWVRQAPGKGLEWVSLVGWDGFFTYYADSVKGRFTISRDNAKNSLYLQMNSLRAEDTAVYYCARQGDYMGNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5121 - protein, 431 aa, Artificial Sequence
  Description of Artificial Sequence: Synthetic polypeptide
EVQLVESGGGLVKPGGSLRLSCAASGFTFDDSVMHWVRQAPGKGLEWVSLVGWDGFFTYYADSVKGRFTISRDNAKNSLYLQMNSLRAEDTAVYYCARQGDYMGNNWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5122 - protein, 117 aa, Artificial Sequence
  Description of Artificial Sequence: Synthetic polypeptide
QVNLRESGGGLVKPGGSLRLSCAASGFTFDDSVMHWVRQAPGKGLEWLSLVGWDGFFTYYADSVKGRFTISRDNTKNLLYLQMNSLRAEDTAVYYCARQGDYVFNNWGQGTLVTVSS

SEQ ID NO: 5123 - protein, 117 aa, Artificial Sequence
  Description of Artificial Sequence: Synthetic polypeptide
QVNLRESGGGLVKPGGSLRLSCAASGFTFDDSVMHWVRQAPGKGLEWLSLVGWDGFFTYYADSVKGRFTISRDNTKNLLYLQMNSLRAEDTAVYYCARQGDYMGDYWGQGTLVTVSS

SEQ ID NO: 5124 - protein, 120 aa, Artificial Sequence [sequence omitted]

SEQ ID NO: 5125 - protein, 452 aa, Artificial Sequence
  Description of Artificial Sequence: Synthetic polypeptide
QVQLVQSGAEVKKPGSSVKVSCKASGGTFSYYWIEWVRQAPGQGLEWMGEILPGSGTTNPNEKFKGRVTITADESTSTAYMELSSLRSEDTAVYYCARADYYGSDYVKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5126 - protein, 444 aa, Artificial Sequence
  Description of Artificial Sequence: Synthetic polypeptide
QVQLVQSGAEVKKPGASVKVSCKVSGYTLSDLSIHWVRQAPGKGLEWMGGFDPQDGETIYAQKFQGRVTMTEDTSTDTAYMELSSLKSEDTAVYYCATGSSSSWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5127 - protein, 446 aa, Artificial Sequence
  Description of Artificial Sequence: Synthetic polypeptide
QVQLQESGPGLVKPSETLSLTCTVSGFSLTNYGIHWIRQPPGKGLEWLGVIWARGFTNYNSALMSRLTISKDNSKNQVSLKLSSVTAADTAVYYCARANDGVYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5128 - protein, 447 aa, Artificial Sequence
  Description of Artificial Sequence: Synthetic polypeptide
QVQLVESGGGVVQPGRSLRLSCAASGFTFSSYDMSWVRQAPGKGLEWVAKVSSGGGSTYYLDTVQGRFTISRDNSKNTLYLQMNSLRAEDTAVYYCARHLHGSFASWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5129 - protein, 449 aa, Artificial Sequence
  Description of Artificial Sequence: Synthetic polypeptide
QVQLVESGGGVVQPGRSRRLSCAASGFTFSRYTMHWVRQAPGKGLEWVAVISFDGSNKYYVDSVKGRFTISRDNSENTLYLQVNILRAEDTAVYYCAREARGSYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5130 - protein, 446 aa, Artificial Sequence
  Description of Artificial Sequence: Synthetic polypeptide
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5131 - protein, 450 aa, Artificial Sequence
  Description of Artificial Sequence: Synthetic polypeptide
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5132 - protein, 450 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSL

SEQ ID NO: 5133 - protein, 452 aa, Artificial Sequence
  Description of Artificial Sequence: Synthetic polypeptide
EVQLVQSGAEVKKPGATVKISCKVSGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5134 - protein, 452 aa, Artificial Sequence
  Description of Artificial Sequence: Synthetic polypeptide
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5135 - protein, 452 aa, Artificial Sequence
  Description of Artificial Sequence: Synthetic polypeptide
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5136 - protein, 451 aa, Artificial Sequence
  Description of Artificial Sequence: Synthetic polypeptide
EVQLVQSGAEVKKPGATVKISCKVSGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5137 - protein, 451 aa, Artificial Sequence
  Description of Artificial Sequence: Synthetic polypeptide
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5138 - protein, 451 aa, Artificial Sequence
  Description of Artificial Sequence: Synthetic polypeptide
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5139 - protein, 452 aa, Artificial Sequence
  Description of Artificial Sequence: Synthetic polypeptide
EVQLVQSGAEVKKPGATVKISCKVSGFTLTNYGMNWIRQSPSRGLEWLGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5140 - protein, 452 aa, Artificial Sequence
  Description of Artificial Sequence: Synthetic polypeptide
QIQLVQSGPELKKPGETVKISCKASGFTLTNYGMNWVRQTPGKGLKWMGWINTDTGEPTYADDFKGRFAFSLETSASTASLQINNLKNADTATYFCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5141 - protein, 452 aa, Artificial Sequence
  Description of Artificial Sequence: Synthetic polypeptide
EVQLVQSGAEVKKPGATVKISCKVSGFTLTNYGMNWVRQAPGQGLEWMGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5142 - protein, 452 aa, Artificial Sequence
  Description of Artificial Sequence: Synthetic polypeptide
QVQLVQSGAEVKKPGASVKVSCKASGFTLTNYGMNWVRQARGQRLEWIGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5143 - protein, 452 aa, Artificial Sequence
  Description of Artificial Sequence: Synthetic polypeptide
QVQLVQSGAEVKKPGASVKVSCKASGFTLTNYGMNWVRQAPGQGLEWMGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5144 - protein, 452 aa, Artificial Sequence
  Description of Artificial Sequence: Synthetic polypeptide
EVQLVQSGAEVKKPGATVKISCKVSGFTLTNYGMNWIRQSPSRGLEWLGWINTDTGEPTYADDFKGRFVFSLDTSVSTAYLQICSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5145 - protein, 452 aa, Artificial Sequence
  Description of Artificial Sequence: Synthetic polypeptide
EVQLVQSGAEVKKPGESLRISCKGSGFTLTNYGMNWVRQATGQGLEWMGWINTDTGEPTYADDFKGRVTISADKSISTAYLQWSSLKASDTAMYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5146 - protein, 452 aa, Artificial Sequence
  Description of Artificial Sequence: Synthetic polypeptide
QVQLVQSGSELKKPGASVKVSCKASGFTLTNYGMNWVRQAPGQGLEWMGWINTDTGEPTYADDFKGRFVFSLDTSVSTAYLQISTLKAEDTATYFCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5147 - protein, 447 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSAYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5148 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 5149 - protein, 447 aa, Artificial Sequence; identical to SEQ ID NO: 5147
  Description of Artificial Sequence: Synthetic polypeptide

SEQ ID NO: 5150 - protein, 447 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5151 - protein, 443 aa, Artificial Sequence
  Description of Artificial Sequence: Synthetic polypeptide
QVQLVQSGAEVKKPGASVKVSCKASGYAFTYYLIEWVRQAPGQGLEWIGVINPGSGGTNYNEKFKGRATITADKSTSTAYMELSSLRSEDTAVYFCARNWMNFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5152 - protein, 448 aa, Artificial Sequence
  Description of Artificial Sequence: Synthetic polypeptide
QVQLQQSGSELKKPGASVKVSCKASGFTFTNYGMNWVKQAPGQGLKWMGWINTYTREPTYADDFKGRFAFSLDTSVSTAYLQISSLKADDTAVYFCARDITAVVPTGFDYWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5153 - protein, 449 aa, Artificial Sequence
  Description of Artificial Sequence: Synthetic polypeptide
QVQLQQSGPELVKPGASVKMSCKASGYTFTSYYIYWVKQRPGQGLEWLGWIWPGDGSTKYNEKFKDKTTLTADKSSNTAYMFLSSLTSEDSAVYFCASPMITPNYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5154 - protein, 449 aa, Artificial Sequence
  Description of Artificial Sequence: Synthetic polypeptide
QVQLQQSGPELVKPGASVKMSCKASGYTFTSYYIHWVKQRPGQGLEWIGWIWPGDGSTKYNEKFKGKTTLTADKSSSTAYMFLSSLTSEDSAVYFCASPMITPNYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5155 - protein, 449 aa, Artificial Sequence
  Description of Artificial Sequence: Synthetic polypeptide
QVQLQQSGSELVKPGASVKLSCKASGYTFTSYYIHWVKQRPGQGLEWIGWIWPGDGSTKYNERFKGKTTLTADKSSSTAYMFLSSLTSEDSAVYFCASPMITPNYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5156 - protein, 449 aa, Artificial Sequence
  Description of Artificial Sequence: Synthetic polypeptide
QVQLQQSGPELVKPGDSVKMSCKASGYSFTSYFIHWVKQRPGQGLEWIGWIWPGDGSTKYNEKFKGKTTLTTDKSSSTAYMFLNSLTSEDSAVYFCASPMITPNYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5157 - protein, 449 aa, Artificial Sequence
  Description of Artificial Sequence: Synthetic polypeptide
QVQLQQSGSELVKPGASVKMSCKASGYTFTSYYIHWVKQRPGQGLEWIGWIWPGDGSTKYNERFKGKTTLTADKSSSTAYMFLSSLTSEDSAVYFCASPMITPNYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5158 - protein, 449 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5159 - protein, 449 aa, Artificial Sequence
  Description of Artificial Sequence: Synthetic polypeptide
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 5160 - protein, 250 aa, Artificial Sequence
  Description of Artificial Sequence: Synthetic polypeptide
EVQLVESGAEVKKPGASVKVSCKASGYTFTSYYMHWVRQAPGQGLEWMGIINPSGGSTSYAQKFQGRVTMTRDTSTSTVYMELSSLRSEDTAVYYCAREGDNYYGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCAAAHHHHHHGAAEQKLISEEDLNGAA

SEQ ID NO: 5161 - protein, 249 aa, Artificial Sequence
  Description of Artificial Sequence: Synthetic polypeptide
QLQLQESGPGLVKPSETLSLTCTVSGVSISSRSGHWGWVRQPPGKGLEWIGSISYSGSTYYNPSLKSRVTISVDTSKNQLSLKLSSVTAADTAVYYCARESHPAAALVGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCAAAHHHHHHGAAEQKLISEEDLNGAA

SEQ ID NO: 5162 - protein, 264 aa, Artificial Sequence
  Description of Artificial Sequence: Synthetic polypeptide
QVQLQESGGGLVKPGGSLRLSCAASGFTFSSYSMNWVRQAPGKGLEWVSSISSSSSYIYYADSVKGRFTISRDNAKNSLYLQMNSLRAEDTAVYYCARVRGHRYYYDSSGYYSSDYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCAAAHHHHHHGAAEQKLISEEDLNGAA

SEQ ID NO: 5163 - protein, 249 aa, Artificial Sequence
  Description of Artificial Sequence: Synthetic polypeptide
QVQLQESGPGLVKPSETLSLTCTVSGGSISGYYWSWIRQPPGKGLEWIGYIYYSGSTNYNPSLKSRVSISVDTSKNQFSLRLSSVTAADSAVYFCARDERDAYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCAAAHHHHHHGAAEQKLISEEDLNGAA

SEQ ID NO: 5164 - protein, 258 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDRSFWSGYYIINYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCAAAHHHHHHGAAEQKLISEEDLNGAA

SEQ ID NO: 5165 - protein, 448 aa, Artificial Sequence
  Description of Artificial Sequence: Synthetic polypeptide
EVQLLESGGGLVQPGGSLRLSCAASGFTFSIYSMNWVRQAPGKGLEWVSSIGSSGGTTYYADSVKGRFTISRDNSKNTLYLQMNSLRAEDTAVYYCAGSQWLYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5166 - protein, 119 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5167 - protein, 449 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5168 - protein, 451 aa, Artificial Sequence
  Description of Artificial Sequence: Synthetic polypeptide
QVQLQQSGAEVKKPGSSVKVSCKASGYTFTSYNMHWVKQAPGQGLEWIGAIYPGMGDTSYNQKFKGKATLTADESTNTAYMELSSLRSEDTAFYYCARSTYYGGDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5169 - protein, 449 aa, Artificial Sequence; identical to SEQ ID NO: 5167
  Description of Artificial Sequence: Synthetic polypeptide

SEQ ID NO: 5170 - protein, 448 aa, Artificial Sequence; identical to SEQ ID NO: 4892
  Description of Artificial Sequence: Synthetic polypeptide

SEQ ID NO: 5171 - protein, 450 aa, Artificial Sequence
  Description of Artificial Sequence: Synthetic polypeptide
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKIKDTLMISRTPEVTCVVVDVSHEDPEVKFNWYVDGVEVHNAKTKPREEQYNSTYRVVSVLTVLHQDWLNGKEYKCKVSNKALPAPIEKTISKQKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5172 - protein, 450 aa, Artificial Sequence
  Description of Artificial Sequence: Synthetic polypeptide
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5173 - protein, 452 aa, Artificial Sequence
  Description of Artificial Sequence: Synthetic polypeptide
EVQLVESGGGLVQPGGSLRLSCAASGFTFSSYLMTWVRQAPGKGLEWVANIKQDGSEKYYVDSVKGRFTISRDNAKNSLNLQMNSLRAEDTAVYYCTRDGYSSGRHYGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5174 - protein, 449 aa, Artificial Sequence
  Description of Artificial Sequence: Synthetic polypeptide
QVQLVQSGAEVKKPGETVKISCKASDYTFTYYGMNWVKQAPGQGLKWMGWIDTTTGEPTYAQKFQGRIAFSLETSASTAYLQIKSLKSEDTATYFCARRGPYNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5175 - protein, 449 aa, Artificial Sequence
  Description of Artificial Sequence: Synthetic polypeptide
QVQLQQSGAEVKKPGASVKVSCEASGYTFPSYVLHWVKQAPGQGLEWIGYINPYNDGTQYNEKFKGKATLTRDTSINTAYMELSRLRSDDTAVYYCARGFGGSYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5176 - protein, 443 aa, Artificial Sequence
  Description of Artificial Sequence: Synthetic polypeptide
QVQLKESGPDLVAPSQSLSITCTVSGFSLSKFGVNWVRQPPGKGLEWLGVIWGDGSTSYNSGLISRLSISKENSKSQVFLKLNSLQADDTATYYCVKPGGDYWGHGTSVTVSSASTKGPSVFPLAPSSKSTSGGTAALGCLVKDYFPEPVTVSWNSGALTSGVHTFPAVLQSSGPYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTMPPVLDSDGSFFLYSKLTVDKSRWQQGNVFSCSVMHEALHNHYTQKSLSLSPGK

SEQ ID NO: 5177 - protein, 449 aa, Artificial Sequence
  Description of Artificial Sequence: Synthetic polypeptide
QVQLVQSGAEVKKPGETVKISCKASDYTFTYYGMNWVKQAPGQGLKWMGWIDTTTGEFTYAQKFQGRIAFSLETSASTAYLQIKSLKSEDTATYFCARRGPYNWYTDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNSFHKPSNTKVTDKKVEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5178 - protein, 448 aa, Artificial Sequence
  Description of Artificial Sequence: Synthetic polypeptide
QVQLVESGGGVVQPGRSLRLSCAASGFTFSSFGMHWVRQAPGKGLEWVAYISSGSFTIYYADSVKGRFTISRDNSKNTLYLQMNSLRAEDTAVYYCARMRKGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5179 - protein, 441 aa, Artificial Sequence
  Description of Artificial Sequence: Synthetic polypeptide
EVQLVESGGGLVQPGGSLRLSCAASGFTFSSSGMSWVRQAPGKGLEWVSVIASSGSNTYYADSVKGRFTISRDNSKNTLYLQMNSLRAEDTAVYYCARSIFYTTWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5180 - protein, 447 aa, Artificial Sequence
  Description of Artificial Sequence: Synthetic polypeptide
QVQLVQSGAEVKKPGASVKISCKVSGYTLRGYWIEWVRQAPGKGLEWIGQILPGTGRTNYNEKFKGRVTMTADTSTDTAYMELSSLRSEDTAVYYCARFDGNYGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5181 - protein, 453 aa, Artificial Sequence
  Description of Artificial Sequence: Synthetic polypeptide
EVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARGELPYYRMSKVMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5182 - protein, 449 aa, Artificial Sequence
  Description of Artificial Sequence: Synthetic polypeptide
EVQLLESGGGLVQPGGSLRLSCAASGFTFNSYAMSWVRQAPGKGLEWVSIISGSGGFTYYADSVKGRFTISRDNSRTTLYLQMNSLRAEDTAVYYCAKDRLVAPGTFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5183 - protein, 443 aa, Artificial Sequence
  Description of Artificial Sequence: Synthetic polypeptide
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5184 - protein, 444 aa, Artificial Sequence
  Description of Artificial Sequence: Synthetic polypeptide
QVQLQQPGSELVRPGASVKLSCKASGYTFTTYWMHWVRQRPGQGLEWIGNIYPGTGGSNFDEKFKNRTSLTVDTSSTTAYMHLASLTSEDSAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5185 - protein, 444 aa, Artificial Sequence
  Description of Artificial Sequence: Synthetic polypeptide
QVQLQQSGSELVRPGASVKLSCKASGYTFTTYWMHWVRQRPGQGLEWIGNIYPGTGGSNFDEKFKNRTSLTVDTSSTTAYMHLASLTSEDSAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5186 - protein, 444 aa, Artificial Sequence
  Description of Artificial Sequence: Synthetic polypeptide
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5187 - protein, 444 aa, Artificial Sequence
  Description of Artificial Sequence: Synthetic polypeptide
EVQLVQSGAEVKKPGESLRISCKGSGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5188 - protein, 444 aa, Artificial Sequence
  Description of Artificial Sequence: Synthetic polypeptide
QVQLVQSGAEVKKPGASVKVSCKASGYTFTTYWMHWIRQSPSRGLEWLGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5189 - protein, 444 aa, Artificial Sequence
  Description of Artificial Sequence: Synthetic polypeptide
EVQLVQSGAEVKKPGESLRISCKGSGYTFTTYWMHWVRQAPGQGLEWMGNIYPGTGGSNFDEKFKNRFTISRDNSKNTLYLQMNSLRAEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5190 - protein, 443 aa, Artificial Sequence
  Description of Artificial Sequence: Synthetic polypeptide
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5191 - protein, 447 aa, Artificial Sequence
  Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5192 - protein, 457 aa, Artificial Sequence
  Description of Artificial Sequence: Synthetic polypeptide
QLQLQESGPGLVKPSETLSLTCTVSGGSINSSSYYWGWLRQSPGKGLEWIGSFFYTGSTYYNPSLRSRLTISVDTSKNQFSLMLSSVTAADTAVYYCARQSTYYYGSGNYYGWFDRWDQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5193 - protein, 446 aa, Artificial Sequence
  Description of Artificial Sequence: Synthetic polypeptide
QVQLVESGGGLVKPGGSLRLSCAASGFTFSDYYMNWIRQAPGKGLEWVSYISSSGSIIYYADSVKGRFTISRDNAKNSLYLQMNSLRAEDTAVYYCAREGRIAARGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5194 - protein, 448 aa, Artificial Sequence
  Description of Artificial Sequence: Synthetic polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5195 - protein, 451 aa, Artificial Sequence
  Description of Artificial Sequence: Synthetic polypeptide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5196 - protein, 118 aa, Artificial Sequence
  Description of Artificial Sequence: Synthetic polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 5197 - protein, 440 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5198 - protein, 118 aa, Artificial Sequence [sequence omitted]

SEQ ID NO: 5199 - protein, 447 aa, Artificial Sequence
  Description of Artificial Sequence: Synthetic polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5200 - protein, 122 aa, Artificial Sequence
  Description of Artificial Sequence: Synthetic polypeptide
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTK

SEQ ID NO: 5201 - protein, 450 aa, Artificial Sequence
  Description of Artificial Sequence: Synthetic polypeptide
EVQLQQSGPELEKPGASVKLSCKASGYSFTGYNMNWVKQSHGKSLEWIGHIDPYYGDTSYNQKFRGKATLTVDKSSSTAYMQLKSLTSEDSAVYYCVKGGYYGHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5202 - protein, 447 aa, Artificial Sequence
  Description of Artificial Sequence: Synthetic polypeptide
EVQLVESGGGLVQPGGSLRLSCAASGFTFSSYNMNWVRQAPGKGLEWVSYISSSSSTIYYADSVKGRFTISRDNAKNSLSLQMNSLRDEDTAVYYCARAYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5203 - protein, 216 aa, Artificial Sequence
  Description of Artificial Sequence: Synthetic polypeptide
EVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5204 - protein, 240 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSSASTKGPEVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVSS

SEQ ID NO: 5205 - protein, 239 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPEVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVSS

SEQ ID NO: 5206 - protein, 237 aa, Artificial Sequence
  Description of Artificial Sequence: Synthetic polypeptide
QVQLVESGGGVVQPGRSLRLSCAASGFTFSSFGMHWVRQAPGKGLEWVAYISSGSFTIYYADSVKGRFTISRDNSKNTLYLQMNSLRAEDTAVYYCARMRKGYAMDYWGQGTLVTVSSASTKGPEVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVSS

SEQ ID NO: 5207 - protein, 449 aa, Artificial Sequence
  Description of Artificial Sequence: Synthetic polypeptide
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5208 - protein, 450 aa, Artificial Sequence
  Description of Artificial Sequence: Synthetic polypeptide
EVQLVESGGGLVQPGGSLRLSCAASGFSFSDFAMSWVRQAPGKGLEWVATIGRVAFHTYYPDSMKGRFTISRDNSKNTLYLQMNSLRAEDTAVYYCARHRGFDVGHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5209 - protein, 454 aa, Artificial Sequence
  Description of Artificial Sequence: Synthetic polypeptide
EVQLVESGGGLVQPGGSLRLSCAVSGYSITSDYAWNWVRQAPGKGLEWVGYISNSGSTSYNPSLKSRFTISRDTSKNTLYLQMNSLRAEDTAVYYCARERNYDYDDYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5210 - protein, 470 aa, Artificial Sequence
  Description of Artificial Sequence: Synthetic polypeptide
MKHLWFFLLLVAAPRWVLSQVQLQESGPGLVKPSETLSLTCAVSGFSLSRYGINWVRQAPGSGLEWIGAIGETGRAYYASWAKSRSTISRDTSKNQVSLKMSSVTAADTAVYFCARGELFNNGWGAFNIWGPGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5211 - protein, 469 aa, Artificial Sequence
  Description of Artificial Sequence: Synthetic polypeptide
METGLRWLLLVAVLKGVQCQQLQESGPGLVKPSETLSLTCAVSGFSLSRYGINWVRQAPGSGLEWIGAIGETGRAYYASWAKSRSTISRDTSKNQVSLKMSSVTAADTAVYFCARGELFNNGWGAFNIWGPGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5212 - protein, 451 aa, Artificial Sequence
  Description of Artificial Sequence: Synthetic polypeptide
EVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5213 - protein, 452 aa, Artificial Sequence
  Description of Artificial Sequence: Synthetic polypeptide
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5214 - protein, 449 aa, Artificial Sequence
  Description of Artificial Sequence: Synthetic polypeptide
EVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5215 - protein, 449 aa, Artificial Sequence
  Description of Artificial Sequence: Synthetic polypeptide
EVQLVESGGGLVQPGGSLRLSCAASGFTFSSYWMSWVRQAPGKGLEWVAEIRLKSDNYATHYAESVKGRFTISRDDSKNSLYLQMNSLRAEDTAVYYCTGYYADAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5216 - protein, 446 aa, Artificial Sequence
  Description of Artificial Sequence: Synthetic polypeptide
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5217 - protein, 447 aa, Artificial Sequence
  Description of Artificial Sequence: Synthetic polypeptide
VQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5218 - protein, 450 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYDILTGYYYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5219 - protein, 451 aa, Artificial Sequence
  Description of Artificial Sequence: Synthetic polypeptide
EVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5220 - protein, 453 aa, Artificial Sequence
  Description of Artificial Sequence: Synthetic polypeptide
EVKLLESGGGLVQPGGSLRLSCAASGFTFSTYTMSWVRQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5221 - protein, 453 aa, Artificial Sequence
  Description of Artificial Sequence: Synthetic polypeptide
EVQLLESGGGLVQPGGSLRLSCAASGFTFSTYTMSWVRQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5222 - protein, 453 aa, Artificial Sequence
  Description of Artificial Sequence: Synthetic polypeptide
EVKLLESGGGLVQPGGSLRLSCAASGFTFSTYTMSWARQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5223 - protein, 450 aa, Artificial Sequence
  Description of Artificial Sequence: Synthetic polypeptide
EVKLLESGGGLVQPGGSLRLSCAASGFTFSTYTMSWARQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5224 - protein, 453 aa, Artificial Sequence
  Description of Artificial Sequence: Synthetic polypeptide
EVKLLESGGGLVQPGGSLRLSCAASGFTFSTYTMSWVRQTPEKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5225 - protein, 453 aa, Artificial Sequence
  Description of Artificial Sequence: Synthetic polypeptide
EVKLLESGGGLVQPGGSLRLSCAASGFTFSTYTMSWVRQTPGKRLEWVAYISKGGGSTYYPDTVKGRFTISRDNSKNTLYLQMNSLRAEDTALYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5226 - protein, 453 aa, Artificial Sequence
  Description of Artificial Sequence: Synthetic polypeptide
EVKLLESGGGLVQPGGSLRLSCAASGFTFSTYTMSWVRQTPGKRLEWVAYISKGGGSTYYPDTVKGRFTISRDNSKNTLYLQMNSLRAEDTAVYYCAKGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5227 - protein, 453 aa, Artificial Sequence
  Description of Artificial Sequence: Synthetic polypeptide
EVQLLESGGGLVQPGGSLRLSCAASGFTFSTYTMSWARQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5228 - protein, 450 aa, Artificial Sequence
  Description of Artificial Sequence: Synthetic polypeptide
EVQLLESGGGLVQPGGSLRLSCAASGFTFSTYTMSWARQTPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5229 - protein, 453 aa, Artificial Sequence
  Description of Artificial Sequence: Synthetic polypeptide
EVQLLESGGGLVQPGGSLRLSCAASGFTFSTYTMSWVRQAPGKRLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5230 - protein, 453 aa, Artificial Sequence
  Description of Artificial Sequence: Synthetic polypeptide
EVKLLESGGGLVQPGGSLRLSCAASGFTFSTYTMSWVRQTPGKRLEWVAYISKGGGSTYYADSVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5231 - protein, 453 aa, Artificial Sequence
  Description of Artificial Sequence: Synthetic polypeptide
EVQLLESGGGLVQPGGSLRLSCAASGFTFSTYTMSWARQTPGKGLEWVAYISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5232 - protein, 453 aa, Artificial Sequence
  Description of Artificial Sequence: Synthetic polypeptide
EVQLLESGGGLVQPGGSLRLSCAASGFTFSTYTMSWVRQTPGKRLEWVSAISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5233 - protein, 453 aa, Artificial Sequence
  Description of Artificial Sequence: Synthetic polypeptide
EVQLLESGGGLVQPGGSLRLSCAASGFTFSTYTMSWVRQTPGKRLEWVAYISKGGGSTYYADSVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5234 - protein, 453 aa, Artificial Sequence
  Description of Artificial Sequence: Synthetic polypeptide
EVQLLESGGGLVQPGGSLRLSCAASGFTFSTYTMSWVRQAPGKRLEWVAYISKGGGSTYYADSVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5235 - protein, 453 aa, Artificial Sequence
  Description of Artificial Sequence: Synthetic polypeptide
EVQLLESGGGLVQPGGSLRLSCAASGFTFSTYTMSWARQAPGKRLEWVAYISKGGGSTYYADSVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5236 - protein, 453 aa, Artificial Sequence
  Description of Artificial Sequence: Synthetic polypeptide
EVQLLESGGGLVQPGGSLRLSCAASGFTFSTYTMSWVRQAPGKGLEWVSAISKGGGSTYYPDTVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5237 - protein, 453 aa, Artificial Sequence
  Description of Artificial Sequence: Synthetic polypeptide
EVQLLESGGGLVQPGGSLRLSCAASGFTFSTYTMSWVRQTPGKRLEWVSAISKGGGSTYYADSVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5238 - protein, 453 aa, Artificial Sequence
  Description of Artificial Sequence: Synthetic polypeptide
EVQLLESGGGLVQPGGSLRLSCAASGFTFSTYTMSWVRQAPGKGLEWVSAISKGGGSTYYADSVKGRFTISRDNSKNTLYLQMNSLRAEDTAVYYCARGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5239 - protein, 453 aa, Artificial Sequence
  Description of Artificial Sequence: Synthetic polypeptide
EVQLLESGGGLVQPGGSLRLSCAASGFTFSTYTMSWVRQAPGKGLEWVSAISKGGGSTYYADSVKGRFTISRDNSKNTLYLQMNSLRAEDTAVYYCAKGAMYGNDFFYPMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5240 - protein, 448 aa, Artificial Sequence
  Description of Artificial Sequence: Synthetic polypeptide
QMQLVESGGGVVQPGRSLRLSCAASGFTFRTYGMHWVRQAPGKGLEWVAVIWYDGSNKHYADSVKGRFTITRDNSKNTLNLQMNSLRAEDTAVYYCARAPQWELVHEAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5241 - protein, 117 aa, Artificial Sequence
  Description of Artificial Sequence: Synthetic polypeptide
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 5242 - protein, 451 aa, Artificial Sequence
  Description of Artificial Sequence: Synthetic polypeptide
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5243 - protein, 449 aa, Artificial Sequence
  Description of Artificial Sequence: Synthetic polypeptide
QVQLVQSGSELKKPGASVKISCKASGYTFTSYAMNWVRQAPGQGLESMGWINTNTGNPTYAQGFTGRFVFSMDTSVSTAYLQISSLKAEDTAIYYCAPRYSSSWYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5244 - protein, 453 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5245 - protein, 228 aa, Artificial Sequence
  Description of Artificial Sequence: Synthetic polypeptide
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 5246 - protein, 450 aa, Artificial Sequence
  Description of Artificial Sequence: Synthetic polypeptide
EVQLLESGGDLVQPGGSLRLSCAASGFTFSNYAMSWVRQAPGKGLEWVSAITPSGGSTNYADSVKGRFTISRDNSQNTLYLQMNSLRVEDTAVYICGRVPYRSTWYPLYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5247 - protein, 122 aa, Artificial Sequence
  Description of Artificial Sequence: Synthetic polypeptide
QVQLVQSGAEVKKPGASVKVSCKASGYTFTSYNMHWVRQAPGKGLEWVGAIYPGNGDTSYNQKFKGRVTISADKSISTAYLQWSSLKASDTAMYYCARSHYGSNYVDYFDYWGQGTLVTVSS

SEQ ID NO: 5248 - protein, 122 aa, Artificial Sequence
  Description of Artificial Sequence: Synthetic polypeptide
QVQLVQSGAEVKKPGASVKVSCKASGYTFTSYNMHWVRQAPGKGLEWVGAIYPGNGDTSYNQKFKGRVTITADKSTSTAYMELSSLRSEDTAVYYCARSHYGSNYVDYFDYWGQGTLVTVSS

SEQ ID NO: 5249 - protein, 122 aa, Artificial Sequence
  Description of Artificial Sequence: Synthetic polypeptide
QVQLVQSGAEVKKPGASVKVSCKASGYTFTSYNMHWVRQAPGKGLEWMGAIYPGNGDTSYNQKFKGRFTISRDNAKNSLYLQMNSLRAEDTAVYYCARSHYGSNYVDYFDYWGQGTLVTVSS

SEQ ID NO: 5250 - protein, 122 aa, Artificial Sequence
  Description of Artificial Sequence: Synthetic polypeptide
QVQLVQSGAEVKKPGASVKVSCKASGYTFTSYNMHWVRQAPGKGLEWVGAIYPGNGDTSYNQKFKGRFTISRDNAKNSLYLQMNSLRAEDTAVYYCARSHYGSNYVDYFDYWGQGTLVTVSS

SEQ ID NO: 5251 - protein, 122 aa, Artificial Sequence
  Description of Artificial Sequence: Synthetic polypeptide
QVQLVQSGAEVKKPGASVKVSCKASGYTFTSYNMHWVRQAPGQGLEWMGAIYPGNGDTSYNQKFKGRVTISADKSISTAYLQWSSLKASDTAMYYCARSHYGSNYVDYFDYWGQGTLVTVSS

SEQ ID NO: 5252 - protein, 122 aa, Artificial Sequence
  Description of Artificial Sequence: Synthetic polypeptide
EVQLVQSGAEVKKPGESLKISCKGSGYTFTSYNMHWVRQAPGKGLEWMGAIYPGNGDTSYNQKFKGRVTISADKSISTAYLQWSSLKASDTAMYYCARSHYGSNYVDYFDYWGQGTLVTVSS

SEQ ID NO: 5253 - protein, 122 aa, Artificial Sequence
  Description of Artificial Sequence: Synthetic polypeptide
QVQLVQSGAEVKKPGASVKVSCKASGYTFTSYNMHWVRQAPGKGLEWMGAIYPGNGDTSYNQKFKGRVTITADKSTSTAYMELSSLRSEDTAVYYCARSHYGSNYVDYFDYWGQGTLVTVSS

SEQ ID NO: 5254 - protein, 122 aa, Artificial Sequence
  Description of Artificial Sequence: Synthetic polypeptide
QVQLVQSGAEVKKPGASVKVSCKASGYTFTSYNMHWVRQAPGQGLEWMGAIYPGNGDTSYNQKFKGRVTITADKSTSTAYMELSSLRSEDTAVYYCARSHYGSNYVDYFDYWGQGTLVTVSS

SEQ ID NO: 5255 - protein, 457 aa, Artificial Sequence [sequence omitted]

SEQ ID NO: 5256 - protein, 442 aa, Artificial Sequence
  Description of Artificial Sequence: Synthetic polypeptide
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSSAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVPRDCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 5257 - protein, 448 aa, Artificial Sequence
  Description of Artificial Sequence: Synthetic polypeptide
QVQLQQSRAELVRPGASVTLSCKPSGYTFTDYEVHWVKQTPVHGLEWIGAIDPETGGTADNQKFKGKAILTADKSSSTAYMELRSLTSEDSAVYYCTNFVDVWGTGTTVTVSSASTTAPSVFPLAPSCGSQSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 5258 - protein, 447 aa, Artificial Sequence; identical to SEQ ID NO: 5202
  Description of Artificial Sequence: Synthetic polypeptide

SEQ ID NO: 5259 - protein, 450 aa, Artificial Sequence; identical to SEQ ID NO: 4951
  Description of Artificial Sequence: Synthetic polypeptide

SEQ ID NO: 5260 - protein, 446 aa, Artificial Sequence; identical to SEQ ID NO: 5113
  Description of Artificial Sequence: Synthetic polypeptide

SEQ ID NO: 5261 - protein, 432 aa, Artificial Sequence
  Description of Artificial Sequence: Synthetic polypeptide
QVQLQQSDAELVKPGASVKISCKASGYTFTDHAIHWAKQKPEQGLEWIGYISPGNDDIKYNEKFKGKATLTADKSSSTAYMQLNSLTSEDSAVYFCKRSYYGHWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 5262 - protein, 446 aa, Artificial Sequence
  Description of Artificial Sequence: Synthetic polypeptide
QVQLVQSGAEVKKPGSSVKVSCKASGYTFTSYWLHWVRQAPGQGLEWIGYINPRNDYTEYNQNFKDKATITADESTNTAYMELSSLRSEDTAFYFCARRDITTFYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5263 - protein, 445 aa, Artificial Sequence
  Description of Artificial Sequence: Synthetic polypeptide
QVQLQESGPGLVKPSQTLSLTCSFSGFSLSTSGMGVGWIRQPSGKGLEWLAHIWWDGDESYNPSLKSRLTISKDTSKNQVSLKITSVTAADTAVYFCARNRYDPPWFVDWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 5264 - protein, 449 aa, Artificial Sequence
  Description of Artificial Sequence: Synthetic polypeptide
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5265 - protein, 450 aa, Artificial Sequence
  Description of Artificial Sequence: Synthetic polypeptide
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5266 - protein, 19 aa, Artificial Sequence
  Description of Artificial Sequence: Synthetic peptide
MGWSYIILFLVATATDVHS

SEQ ID NO: 5267 - protein, 448 aa, Artificial Sequence
  Description of Artificial Sequence: Synthetic polypeptide
QVQLVQSGAEVKKPGASVKVSCKASGYIFSNYWIQWVRQAPGQGLEWMGEILPGSGSTEYTENFKDRVTMTRDTSTSTVYMELSSLRSEDTAVYYCARYFFGSSPNWYFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5268 - protein, 140 aa, Artificial Sequence
  Description of Artificial Sequence: Synthetic polypeptide
MGWSCIILFLVATATGVHSQVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSS

SEQ ID NO: 5269 - protein, 451 aa, Artificial Sequence
  Description of Artificial Sequence: Synthetic polypeptide
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5270 - protein, 451 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5271 - protein, 450 aa, Artificial Sequence
  Description of Artificial Sequence: Synthetic polypeptide
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAKTTAPSVYPLAPVCGGTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5272 - protein, 140 aa, Artificial Sequence
  Description of Artificial Sequence: Synthetic polypeptide
MGWSCIILFLVATATGVHSQVQLQQSGAEVKKPGSSVKVSCKASGYTFSSYNMHWVRQAPGQGLEWMGAIYPGNGDTSYNQKFKGRATITADESTNTAYMELSSLRSEDTAFYFCARSTYYGGDWYFDVWGQGTTVTVSS

SEQ ID NO: 5273 - protein, 452 aa, Artificial Sequence; identical to SEQ ID NO: 4850
  Description of Artificial Sequence: Synthetic polypeptide

SEQ ID NO: 5274 - protein, 107 aa, Artificial Sequence
  Description of Artificial Sequence: Synthetic polypeptide
DIQMTQSPSSLSASVGDRVTITCRASQDISKFLNWYQQKPGKAIKLLIYHTSRLHSGVPSRFSGSGSGTDFTLTISSLQPEDFATYYCQQGATLPYTFGPGTKVDIK

SEQ ID NO: 5275 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDHTLTISSLQPEDFATYYCQQGNTLPYTFGPGTKVDIK

SEQ ID NO: 5276 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDSTLTISSLQPEDFATYYCQQGNTLPYTFGPGTKVDIK

SEQ ID NO: 5277 - protein, 5 aa, Artificial Sequence
  Description of Artificial Sequence: Synthetic peptide
SYRMH

SEQ ID NO: 5278 - protein, 17 aa, Artificial Sequence
  Description of Artificial Sequence: Synthetic peptide
YINPSTGYTEYNQKFKD

SEQ ID NO: 5279 - protein, 7 aa, Artificial Sequence
  Description of Artificial Sequence: Synthetic peptide
GGGVFDY

SEQ ID NO: 5280 - protein, 135 aa, Artificial Sequence
  Description of Artificial Sequence: Synthetic polypeptide
MGWSCIILFLVATATGVHSEVQLVESGGGLVQPGGSLRLSCAVSGLSLTSNSVNWIRQAPGKGLEWVGLIWSNGDTDYNSAIKSRFTISRDTSKSTVYLQMNSLRAEDTAVYYCAREYYGYFDYWGQGTLVTVSS

SEQ ID NO: 5281 - protein, 5 aa, Artificial Sequence
  Description of Artificial Sequence: Synthetic peptide
SYTMH

SEQ ID NO: 5282 - protein, 5 aa, Artificial Sequence
  Description of Artificial Sequence: Synthetic peptide
SYAIS

SEQ ID NO: 5283 - protein, 5 aa, Artificial Sequence
  Description of Artificial Sequence: Synthetic peptide
AYSVN

SEQ ID NO: 5284 - protein, 5 aa, Artificial Sequence
  Description of Artificial Sequence: Synthetic peptide
NYWMN

SEQ ID NO: 5285 - protein, 5 aa, Artificial Sequence
  Description of Artificial Sequence: Synthetic peptide
RYGIS

SEQ ID NO: 5286 - protein, 10 aa, Artificial Sequence
  Description of Artificial Sequence: Synthetic peptide
GYIFITYWMT

SEQ ID NO: 5287 - protein, 8 aa, Artificial Sequence
  Description of Artificial Sequence: Synthetic peptide
GFTFRDYA

SEQ ID NO: 5288 - protein, 5 aa, Artificial Sequence
  Description of Artificial Sequence: Synthetic peptide
SYSVH

SEQ ID NO: 5289 - protein, 5 aa, Artificial Sequence
  Description of Artificial Sequence: Synthetic peptide
SFAMS

SEQ ID NO: 5290 - protein, 5 aa, Artificial Sequence
  Description of Artificial Sequence: Synthetic peptide
TYWLG

SEQ ID NO: 5291 - protein, 6 aa, Artificial Sequence
  Description of Artificial Sequence: Synthetic peptide
NDYAMH

SEQ ID NO: 5292 - protein, 5 aa, Artificial Sequence
  Description of Artificial Sequence: Synthetic peptide
SYVLH

SEQ ID NO: 5293 - protein, 5 aa, Artificial Sequence
  Description of Artificial Sequence: Synthetic peptide
DHAIH

SEQ ID NO: 5294 - protein, 5 aa, Artificial Sequence
  Description of Artificial Sequence: Synthetic peptide
NSGMN

SEQ ID NO: 5295 - protein, 5 aa, Artificial Sequence
  Description of Artificial Sequence: Synthetic peptide
NYWIQ

SEQ ID NO: 5296 - protein, 10 aa, Artificial Sequence
  Description of Artificial Sequence: Synthetic peptide
GFTFSPFAMS

SEQ ID NO: 5297 - protein, 10 aa, Artificial Sequence
  Description of Artificial Sequence: Synthetic peptide
GFIFSSYAMH

SEQ ID NO: 5298 - protein, 17 aa, Artificial Sequence
  Description of Artificial Sequence: Synthetic peptide
FISYDGNNKYYADSVKG

SEQ ID NO: 5299 - protein, 17 aa, Artificial Sequence
  Description of Artificial Sequence: Synthetic peptide
GIIPIFGTANYAQKFQG

SEQ ID NO: 5300 - protein, 16 aa, Artificial Sequence
  Description of Artificial Sequence: Synthetic peptide
MIWGDGKIVYNSALKS

SEQ ID NO: 5301 - protein, 16 aa, Artificial Sequence
  Description of Artificial Sequence: Synthetic peptide
AINQDGSEKYYVGSVK

SEQ ID NO: 5302 - protein, 17 aa, Artificial Sequence
  Description of Artificial Sequence: Synthetic peptide
WISTYSGNTNYAQKLQG

SEQ ID NO: 5303 - protein, 16 aa, Artificial Sequence
  Description of Artificial Sequence: Synthetic peptide
QIFPASGSADYNEMFE

SEQ ID NO: 5304 - protein, 16 aa, Artificial Sequence
  Description of Artificial Sequence: Synthetic peptide
QIFPASGSADYNEKFE

SEQ ID NO: 5305 - protein, 16 aa, Artificial Sequence
  Description of Artificial Sequence: Synthetic peptide
QIFPASGSADYAQKLQ

SEQ ID NO: 5306 - protein, 8 aa, Artificial Sequence
  Description of Artificial Sequence: Synthetic peptide
ISGSGGNT

SEQ ID NO: 5307 - protein, 16 aa, Artificial Sequence
  Description of Artificial Sequence: Synthetic peptide
VIWASGGTDYNSALMS

SEQ ID NO: 5308 - protein, 17 aa, Artificial Sequence
  Description of Artificial Sequence: Synthetic peptide
EISSGGSYTYYPDTVTG

SEQ ID NO: 5309 - protein, 16 aa, Artificial Sequence
  Description of Artificial Sequence: Synthetic peptide
IMSPVDSDIRYSPSFQ

SEQ ID NO: 5310 - protein, 17 aa, Artificial Sequence
  Description of Artificial Sequence: Synthetic peptide
TISWNSGSIGYADSVKG

SEQ ID NO: 5311 - protein, 17 aa, Artificial Sequence
  Description of Artificial Sequence: Synthetic peptide
YINPYNDGTQYNEKFKG

SEQ ID NO: 5312 - protein, 17 aa, Artificial Sequence
  Description of Artificial Sequence: Synthetic peptide
YFSPGNDDFKYNERFKG

SEQ ID NO: 5313 - protein, 17 aa, Artificial Sequence
  Description of Artificial Sequence: Synthetic peptide
VIWYDGSKRYYADSVKG

SEQ ID NO: 5314 - protein, 17 aa, Artificial Sequence
  Description of Artificial Sequence: Synthetic peptide
EILPGSGSTEYTENFKD

SEQ ID NO: 5315 - protein, 17 aa, Artificial Sequence
  Description of Artificial Sequence: Synthetic peptide
KISPGGSWTYYSDTVTG

SEQ ID NO: 5316 - protein, 17 aa, Artificial Sequence
  Description of Artificial Sequence: Synthetic peptide
FMSYDGSNKKYADSVKG

SEQ ID NO: 5317 - protein, 9 aa, Artificial Sequence
  Description of Artificial Sequence: Synthetic peptide
TGWLGPFDY

SEQ ID NO: 5318 - protein, 21 aa, Artificial Sequence
  Description of Artificial Sequence: Synthetic peptide
APLRFLEWSTQDHYYYYYMDV

SEQ ID NO: 5319 - protein, 10 aa, Artificial Sequence
  Description of Artificial Sequence: Synthetic peptide
DGYYPYAMDN

SEQ ID NO: 5320 - protein, 18 aa, Artificial Sequence
  Description of Artificial Sequence: Synthetic peptide
DYYDILTDYYIHYWYFDL

SEQ ID NO: 5321 - protein, 7 aa, Artificial Sequence
  Description of Artificial Sequence: Synthetic peptide
RQLYFDY

SEQ ID NO: 5322 - protein, 7 aa, Artificial Sequence
  Description of Artificial Sequence: Synthetic peptide
GGGGFAY

SEQ ID NO: 5323 - protein, 18 aa, Artificial Sequence
  Description of Artificial Sequence: Synthetic peptide
AKDRLSITIRPRYYGLDV

SEQ ID NO: 5324 - protein, 11 aa, Artificial Sequence
  Description of Artificial Sequence: Synthetic peptide
DPPSSLLRLDY

SEQ ID NO: 5325 - protein, 10 aa, Artificial Sequence
  Description of Artificial Sequence: Synthetic peptide
GLWGYYALDY

SEQ ID NO: 5326 - protein, 10 aa, Artificial Sequence
  Description of Artificial Sequence: Synthetic peptide
RRPGQGYFDF

SEQ ID NO: 5327 - protein, 13 aa, Artificial Sequence
  Description of Artificial Sequence: Synthetic peptide
DIQYGNYYYGMDV

SEQ ID NO: 5328 - protein, 10 aa, Artificial Sequence
  Description of Artificial Sequence: Synthetic peptide
GFGGSYGFAY

SEQ ID NO: 5329 - protein, 6 aa, Artificial Sequence
  Description of Artificial Sequence: Synthetic peptide
SLNMAY

SEQ ID NO: 5330 - protein, 4 aa, Artificial Sequence
  Description of Artificial Sequence: Synthetic peptide
NDDY

SEQ ID NO: 5331 - protein, 13 aa, Artificial Sequence
  Description of Artificial Sequence: Synthetic peptide
YFFGSSPNWYFDV

SEQ ID NO: 5332 - protein, 10 aa, Artificial Sequence
  Description of Artificial Sequence: Synthetic peptide
QLWGYYALDI

SEQ ID NO: 5333 - protein, 17 aa, Artificial Sequence
  Description of Artificial Sequence: Synthetic peptide
DRGIAAGGNYYYYGMDV

SEQ ID NO: 5334 - protein, 451 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5335 - protein, 471 aa, Artificial Sequence
  Description of Artificial Sequence: Synthetic polypeptide
MGWSYIILFLVATATDVHSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5336 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5337 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5338 - protein, 330 aa, Artificial Sequence
  Description of Artificial Sequence: Synthetic polypeptide
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 5339 - protein, 330 aa, Artificial Sequence [sequence omitted]

SEQ ID NO: 5340 - protein, 326 aa, Artificial Sequence; identical to SEQ ID NO: 3049
  Description of Artificial Sequence: Synthetic polypeptide

SEQ ID NO: 5341 - protein, 377 aa, Artificial Sequence
  Description of Artificial Sequence: Synthetic polypeptide
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQYNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 5342 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5343 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5344 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 5345 - protein, 218 aa, Artificial Sequence
  Description of Artificial Sequence: Synthetic polypeptide
EIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5346 - protein, 330 aa, Artificial Sequence; identical to SEQ ID NO: 3051
  Description of Artificial Sequence: Synthetic polypeptide

SEQ ID NO: 5347 - protein, 330 aa, Artificial Sequence; identical to SEQ ID NO: 3051
  Description of Artificial Sequence: Synthetic polypeptide

SEQ ID NO: 5348 - protein, 330 aa, Artificial Sequence
  Description of Artificial Sequence: Synthetic polypeptide
SASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5349 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5350 - protein, 327 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 5351 - protein, 243 aa, Artificial Sequence
  Description of Artificial Sequence: Synthetic polypeptide
KPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5352 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPAAAPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPSK

SEQ ID NO: 5353 - protein, 103 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5354 - protein, 103 aa, Artificial Sequence
  Description of Artificial Sequence: Synthetic polypeptide
PSVFLFPPKPKDTLMISRTPEVTCVVVDVSHEDPEVKFNWYVDGVEVHNAKTKPREEQYNSTYRVVSVLTVLHQDWLNGKEYKCKVSNKGLPSSIEKTISKAK

SEQ ID NO: 5355 - protein, 107 aa, Artificial Sequence
  Description of Artificial Sequence: Synthetic polypeptide
GQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5356 - protein, 118 aa, Artificial Sequence
  Description of Artificial Sequence: Synthetic polypeptide
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 5357 - protein, 118 aa, Artificial Sequence
  Description of Artificial Sequence: Synthetic polypeptide
QVQLVESGGGVVQPGRSLRLSCAASGFTFSSYTMHWVRQAPGKGLEWVTFISYDGSNKHYADSVKGRFTVSRDNSKNTLYLQMNSLRAEDTAIYYCARTGWLGPFDYWGQGTLVTVSS

SEQ ID NO: 5358 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVFYCARAPNYIGAFDVWGQGTMVTVSS

SEQ ID NO: 5359 - protein, 137 aa, Artificial Sequence
  Description of Artificial Sequence: Synthetic polypeptide
MEFGLSWVFLVAILKGVQCEVQLVQSGGGLVHPGGSLRLSCAASGFTFSSFAMHWVRQAPGKGLEWISVIDTRGATYYADSVKGRFTISRDNAKNSLYLQMNSLRAEDMAVYYCARLGNFYYGMDVWGQGTTVTVSS

SEQ ID NO: 5360 - protein, 137 aa, Artificial Sequence
  Description of Artificial Sequence: Synthetic polypeptide
MEFGLSWVFLVAILKGVQCEVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSS

SEQ ID NO: 5361 - protein, 137 aa, Artificial Sequence
  Description of Artificial Sequence: Synthetic polypeptide
MEFGLSWVFLVAILKGVQCEVQLVQSGGGLVQPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSS

SEQ ID NO: 5362 - protein, 444 aa, Artificial Sequence
  Description of Artificial Sequence: Synthetic polypeptide
QVQLVQSGAEVVKPGASVKLSCKASGYIFTSYYMYWVKQAPGQGLEWIGEINPSNGDTNFNEKFKSKATLTVDKSASTAYMELSSLRSEDTAVYYCTRSDGRNDMDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSAYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 5363 - protein, 121 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSA

SEQ ID NO: 5364 - protein, 449 aa, Artificial Sequence
  Description of Artificial Sequence: Synthetic polypeptide
QVTLRESGPALVKPTQTLTLTCTVSGFSLTSYSVHWVRQPPGKGLEWLGVIWASGGTDYNSALMSRLSISKDTSRNQVVLTMTNMDPVDTATYYCARDPPSSLLRLDYWGRGTPVTVSSASTKGPSVFPLAPSSKSTSGGTAALGCLVKDNSGALTYFPEPVTVSWSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPDSDGSENNYKTTPPVLFFLYSKLTVDKSRWQQGNVFSCSVMHEALHNHYTQKSLSLSPGK

SEQ ID NO: 5365 - protein, 119 aa, Artificial Sequence [sequence omitted]

SEQ ID NO: 5366 - protein, 449 aa, Artificial Sequence
  Description of Artificial Sequence: Synthetic polypeptide
QVTLRESGPALVKPTQTLTLTCTVSGFSLTSYSVHWVRQPPGKGLEWLGVSRIWASGGTDYNSALMLSISKDTSRNQVVLTMTNMDPVDTATYYCARDPPSSLLRLDYWGRGTLVTVSSASTKGPSVFPLAPSSKSTSGGTAALGCLVKDNSGALTYFPEPVTVSWSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQLPPSRDELPREPQVYTTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5367 - protein, 122 aa, Artificial Sequence [sequence omitted]

SEQ ID NO: 5368 - protein, 122 aa, Artificial Sequence
  Description of Artificial Sequence: Synthetic polypeptide
EVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSS

SEQ ID NO: 5369 - protein, 125 aa, Artificial Sequence [sequence omitted]

SEQ ID NO: 5370 - protein, 124 aa, Artificial Sequence
  Description of Artificial Sequence: Synthetic polypeptide
QVQLVQSGAEVKKPGASVKVSCKTSRYTFTEYTIHWVRQAPGQRLEWIGGINPNNGIPNYNQKFKGRATLTVGKSASTAYMELSSLRSEDTAVYFCARRRIAYGYDEGHAMDYWGQGTLVTVSS

SEQ ID NO: 5371 - protein, 124 aa, Artificial Sequence
  Description of Artificial Sequence: Synthetic polypeptide
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 5372 - protein, 124 aa, Artificial Sequence
  Description of Artificial Sequence: Synthetic polypeptide
QVQLVQSGAEVKKPGASVKVSCKTSRYTFTEYTIHWVRQAPGQRLEWIGGINPNNGIPNYNQKFKGRVTITVDTSASTAYMELSSLRSEDTAVYFCARRRIAYGYDEGHAMDYWGQGTLVTVSS

SEQ ID NO: 5373 - protein, 124 aa, Artificial Sequence
  Description of Artificial Sequence: Synthetic polypeptide
QVQLVQSGAEVKKPGASVKVSCKTSGYTFTEYTIHWVRQAPGQRLEWIGGINPNNGIPNYNQKFKGRVTITVDTSASTAYMELSSLRSEDTAVYYCARRRIAYGYDEGHAMDYWGQGTLVTVSS

SEQ ID NO: 5374 - protein, 124 aa, Artificial Sequence
  Description of Artificial Sequence: Synthetic polypeptide
QVQLVQSGAEVKKPGASVKVSCKTSRYTFTEYTIHWVRQAPGQRLEWIGGINPNNGIPNYNQKFKGRATLTVGKSASTAYMELSSLRSEDTAVYYCARRRIAYGYDEGHAMDYWGQGTLVTVSS

SEQ ID NO: 5375 - protein, 450 aa, Artificial Sequence; identical to SEQ ID NO: 4923
  Description of Artificial Sequence: Synthetic polypeptide

SEQ ID NO: 5376 - protein, 450 aa, Artificial Sequence
  Description of Artificial Sequence: Synthetic polypeptide
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5377 - protein, 116 aa, Artificial Sequence [sequence omitted]

SEQ ID NO: 5378 - protein, 117 aa, Artificial Sequence
  Description of Artificial Sequence: Synthetic polypeptide
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSA

SEQ ID NO: 5379 - protein, 117 aa, Artificial Sequence
  Description of Artificial Sequence: Synthetic polypeptide
QIQLVESGGGLVKPGGSLRLSCAASGYTFTDYYITWVRQAPGQGLEWMGWIYPGSGNTKYNEKFQGRVTMTVDTSTSTAYMELSSLRSEDTAVYFCANYGNYWFAYWGQGTLVTVSS

SEQ ID NO: 5380 - protein, 117 aa, Artificial Sequence
  Description of Artificial Sequence: Synthetic polypeptide
QIQLVQSGPEVKKPGASVKVSCKASGYTFTDYYITWVRQAPGQGLEWMGWIYPGSGNTKYNEKFQGRFVFSVDTSASTAYLQISSLKAEDTAVYFCANYGNYWFAYWGQGTLVTVSS

SEQ ID NO: 5381 - protein, 111 aa, Artificial Sequence
  Description of Artificial Sequence: Synthetic polypeptide
DIVLTQSPATLSLSPGERATLSCRASQSVDFDGDSYMNWYQQKPGQPPKVLIYAASNLESGIPARFSGSGSGTDFTLTISSLQPEDFATYYCQQSNEDPWTFGGGTKVEIK

SEQ ID NO: 5382 - protein, 111 aa, Artificial Sequence
  Description of Artificial Sequence: Synthetic polypeptide
DIVLTQSPSSLSASVGDRVTITCRASQSVDFDGDSYMNWYQQKPGQPPKVLIYAASNLESGIPARFSGSGSGTDFTLTISSLQPEDFATYYCQQSNEDPWTFGGGTKVEIK

SEQ ID NO: 5383 - protein, 111 aa, Artificial Sequence
  Description of Artificial Sequence: Synthetic polypeptide
DIVLTQSPDSLAVSLGERATINCKASQSVDFDGDSYMNWYQQKPGQPPKVLIYAASNLESGIPARFSGSGSGTDFTLTINSLEAEDAATYYCQQSNEDPWTFGGGTKVEIK

SEQ ID NO: 5384 - protein, 121 aa, Artificial Sequence [sequence omitted]

SEQ ID NO: 5385 - protein, 126 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGPRYYDILTGYRYNWFDPWGRGTLVTVSS

SEQ ID NO: 5386 - protein, 123 aa, Artificial Sequence
  Description of Artificial Sequence: Synthetic polypeptide
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHHALSPWGRGTMVTVSS

SEQ ID NO: 5387 - protein, 122 aa, Artificial Sequence
  Description of Artificial Sequence: Synthetic polypeptide
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 5388 - protein, 119 aa, Artificial Sequence
  Description of Artificial Sequence: Synthetic polypeptide
EVQLVQSGAEVKKPGASVKVSCKASGYTFTNYYIHWVRQAPGQGLEWIGWIYPGDGNTKYNEKFKGRATLTADTSTSTAYLELSSLRSEDTAVYYCARDSYSNYYFDYWGQGTLVTVSS

SEQ ID NO: 5389 - protein, 119 aa, Artificial Sequence
  Description of Artificial Sequence: Synthetic polypeptide
QVQLQQSGPELVKPGASVKISCKASGYTFTNYYIHWVKQRPGQGLEWIGWIYPGDGNTKYNEKFKGKATLTADTSSSTAYMQLSSLTSEDSAVYYCARDSYSNYYFDYWGQGTTLTVSS

SEQ ID NO: 5390 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDGYSRYYFDYWGQGTLVTVSS

SEQ ID NO: 5391 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSS

SEQ ID NO: 5392 - protein, 119 aa, Artificial Sequence; identical to SEQ ID NO: 5390
  Description of Artificial Sequence: Synthetic polypeptide

SEQ ID NO: 5393 - protein, 119 aa, Artificial Sequence; identical to SEQ ID NO: 5390
  Description of Artificial Sequence: Synthetic polypeptide

SEQ ID NO: 5394 - protein, 119 aa, Artificial Sequence; identical to SEQ ID NO: 5390
  Description of Artificial Sequence: Synthetic polypeptide

SEQ ID NO: 5395 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARTGYSRYYFDYWGQGTLVTVSS

SEQ ID NO: 5396 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDGYSRYAFDYWGQGTLVTVSS

SEQ ID NO: 5397 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARSGYSRYYFDYWGQGTLVTVSS

SEQ ID NO: 5398 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDGYSRAYFDYWGQGTLVTVSS

SEQ ID NO: 5399 - protein, 119 aa, Artificial Sequence
  Description of Artificial Sequence: Synthetic polypeptide
EVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDSYSNYYFDYWGQGTLVTVSS

SEQ ID NO: 5400 - protein, 122 aa, Artificial Sequence
  Description of Artificial Sequence: Synthetic polypeptide
EVQLVESGGGLVQPGGSLRLSCAASGYSFTGYTMNWVRQAPGKDLEWVALINPYKGVSTYNQKFKDRFTISVDKSKNTAYLQMNSLRAEDTAVYYCARSGYYGDSDWYFDVWGQGTLVTVSS

SEQ ID NO: 5401 - protein, 122 aa, Artificial Sequence
  Description of Artificial Sequence: Synthetic polypeptide
EVQLVESGGGLVQPGGSLRLSCAASGYSFTGYTMNWVRQAPGKGLEWVALINPYKGVTTYADSVKGRFTISVDKSKNTAYLQMNSLRAEDTAVYYCARSGYYGDSDWYFDVWGQGTLVTVSS

SEQ ID NO: 5402 - protein, 122 aa, Artificial Sequence
  Description of Artificial Sequence: Synthetic polypeptide
EVQLVESGGGLVQPGGSLRLSCAASGYSFTGYTMNWVRQAPGKGLEWVALINPYKGVSTYADSVKGRFTISVDKSKNTAYLQMNSLRAEDTAVYYCARSGYYGDSDWYFDVWGQGTLVTVSS

SEQ ID NO: 5403 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYADSVKDRFTISRDDSKNTLYLQMNSLRAEDTAVYYCVRHGNFGNSYVSWFAYWGQGTLVTVSS

SEQ ID NO: 5404 - protein, 125 aa, Artificial Sequence
  Description of Artificial Sequence: Synthetic polypeptide
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 5405 - protein, 120 aa, Artificial Sequence
  Description of Artificial Sequence: Synthetic polypeptide
QVQLVQSGSELKKPGASVKVSCKASGYTFTNYGMNWVRQAPGQGLEWMGWINTNTGKPTYAEEFKGRFVFSLDTSVSTAYLQICSLKAEDTAVYYCARRGDYRYAWFLYWGQGTLVTVSS

SEQ ID NO: 5406 - protein, 120 aa, Artificial Sequence
  Description of Artificial Sequence: Synthetic polypeptide
QIQLVQSGPELKKPGETVKISCKASGYTFTNYGMNWVKQAPGKGLKWMGWINTNTGKPTYAEEFKGRFVFSLETSASTTYLQINNLKNEDTATYFCARRGDYRYAWFLYWGQGTLVTVSA

SEQ ID NO: 5407 - protein, 117 aa, Artificial Sequence
  Description of Artificial Sequence: Synthetic polypeptide
EVQLVQSGAEVKKPGASVKVSCKASGYTFTSYYIHWVRQAPGQGLEWIGWIYPGNVNTKYNEKFKGRVTITRDTSTSTAYLELSSLRSEDTAVYYCARNHDYYFDYWGQGTLVTVSS

SEQ ID NO: 5408 - protein, 117 aa, Artificial Sequence
  Description of Artificial Sequence: Synthetic polypeptide
QVQLVQSGAEVKKPGASVKVSCKASGYTFTSYYIHWVRQAPGQRLEWMGWIYPGNVNTKYNEKFKGRVTITADTSASTAYMELSSLRSEDTAVYYCARNHDYYFDYWGQGTLVTVSS

SEQ ID NO: 5409 - protein, 117 aa, Artificial Sequence
  Description of Artificial Sequence: Synthetic polypeptide
EVQLQQSGPELVKPGASVRISCKASGYTFTSYYIHWMKQRPGQGLEWIGWIYPGNVNTKYNEKFKGKATLTADNSSSTANMQLSSLTSEDSAVYFCARNHDYYFDYWGQGTTLTVSS

SEQ ID NO: 5410 - protein, 119 aa, Artificial Sequence
  Description of Artificial Sequence: Synthetic polypeptide
EVQLVESGPGLVKPSETLSLTCTVSGFSLTNYAIHWIRQPPGKGLEWIGVIWAGGNTKYNSALMSRVTISVDTSKNQFSLKLSSVTAADTAVYYCAREDSSGYVALDYWGQGTLVTVSS

SEQ ID NO: 5411 - protein, 119 aa, Artificial Sequence
  Description of Artificial Sequence: Synthetic polypeptide
QVQLKESGPGLVAPSQSLSITCTVSGFSLTNYAIHWVRQPPGKGLDWLGVIWAGGNTKYNSALMSRLSFSKDNSKSQVFLEINSLQTDDTAMYYCAREDSSGYVALDYWGQGTSVTVSS

SEQ ID NO: 5412 - protein, 119 aa, Artificial Sequence
  Description of Artificial Sequence: Synthetic polypeptide
EVQLVESGGGLVQPGGSLRLSCAVSGFSLTNYAIHWVRQAPGKGLEWVGVIWAGGNTKYNSALMSRFTISRDNSKNTLYLQMNSLRAEDTAVYYCAREDSSGYVALDYWGQGTLVTVSS

SEQ ID NO: 5413 - protein, 120 aa, Artificial Sequence
  Description of Artificial Sequence: Synthetic polypeptide
EVQLVESGGGVVQPGGSLKLSCAASGFTFSGSAMHWVRQASEKGLEWVGRIRSRANSYATAYAASVKDRFTISRDNSKNTAYLQMNSLKTEDTAVYYCIRDTMVRGIDYWGQGTLVTVSS

SEQ ID NO: 5414 - protein, 117 aa, Artificial Sequence
  Description of Artificial Sequence: Synthetic polypeptide
QVQLQQSGPELVKPGASVRISCKASGYTFTSDYIHWMRQRPGQGLEWIGWIYFGNVNTKYNEKFKGKAILTADKFSSTAYMQLSSLTSEDSAVYFCARDGGYYFDYWGQGTTLTVSS

SEQ ID NO: 5415 - protein, 117 aa, Artificial Sequence
  Description of Artificial Sequence: Synthetic polypeptide
QVQLQQSGPELVKPGASVKMSCKASGYTFTSHYLHWVKQSPGQGLEWIVWINPGDGNVKYNEKFKDKTTVTADRSSTTVHMFLSSLTSEDSAIYFCARDGAYYFDYWGQGTTLTVSS

SEQ ID NO: 5416 - protein, 117 aa, Artificial Sequence
  Description of Artificial Sequence: Synthetic polypeptide
EVQLQQSGPELVKPGASVKISCKASGYSFTSYYIHWVKQRPGQGLEWIGWIFPGSDNTKYNEKFKGKATLTADTSSSTAYMQLSSLTSEDSAVYFCARNGNYAMDYWGQGTSVTVSS

SEQ ID NO: 5417 - protein, 117 aa, Artificial Sequence; identical to SEQ ID NO: 5409
  Description of Artificial Sequence: Synthetic polypeptide

SEQ ID NO: 5418 - protein, 120 aa, Artificial Sequence
  Description of Artificial Sequence: Synthetic polypeptide
QIQLVQSGPELKKPGETVKISCKASGYTFTNYGMNWVKQAPGKGLKWMGWINTNTGKPTYAEDFKGRFAFSLETSASTAYLQINNLKNEDTATYFCARRGDYRYAWFTYWGQGTLVTVSA

SEQ ID NO: 5419 - protein, 119 aa, Artificial Sequence
  Description of Artificial Sequence: Synthetic polypeptide
EVQLQQSGPELVKPGTSVKISCKASGFSFTNYYIHWMKQRPGQGLEWIGWIYPGSDNTKFNDKFKGKATLTADTSSTTAYMQLSSLTSEDSAVYYCARDSITNYYFDYWGQGTTLTVSS

SEQ ID NO: 5420 - protein, 119 aa, Artificial Sequence
  Description of Artificial Sequence: Synthetic polypeptide
QVQLQQSGSELVRPGASLKLSCKASGYTFTSYWMHWVRQRPGQGLEWIGNFYPGDLTVNYDEKFKNKVTLAVDTSSSTAFLQLSSLTSEDSAVYYCTRDAYSRYFFDYWGQGTTLTVSS

SEQ ID NO: 5421 - protein, 119 aa, Artificial Sequence
  Description of Artificial Sequence: Synthetic polypeptide
QVQLQQSGPELVKPGASVKISCKASGYSFTNYYMHWVKQRPGQGLEWIGWISPGSGSIKYNEKFKGKATLTADTSSSTAYMQLSSLTSEDSAVYYCARDGYSLYFFDFWGQGTTLTVSS

SEQ ID NO: 5422 - protein, 119 aa, Artificial Sequence
  Description of Artificial Sequence: Synthetic polypeptide
QVQLQQSGPELVKPGTSVKISCKTSGYSFINYYTHWVKQRPGQGLEWIGWIYPGNGNIKYNEKFMGKATLTADTSSTTAHMHLSSLVSEDSAVYYCARDSYGSYYFDYWGQGTTLTVSS

SEQ ID NO: 5423 - protein, 119 aa, Artificial Sequence
  Description of Artificial Sequence: Synthetic polypeptide
QVQLQQSGPELVKPGTSVKISCKTSGYNFINYYTHWVKQRPGQGLEWIGWIYPGNGNIKYNEKFMGKATLTADTSSTTAHMHLSSLVSEDSAVYYCARDSYGSYYFDYWGQGTTLTVSS

SEQ ID NO: 5424 - protein, 119 aa, Artificial Sequence
  Description of Artificial Sequence: Synthetic polypeptide
QVQLQQSGPELVKPGASLKISCKASGYSFANYYTHWVRQRPGQGLEWIGWLYPGNGDTRYNEKFKDKATLTADTSSNTASMQLNSLTSEDSAVYYCTRDSYGNYFFDYWGQGTTLIVSS

SEQ ID NO: 5425 - protein, 119 aa, Artificial Sequence
  Description of Artificial Sequence: Synthetic polypeptide
QVQLQQSGSELVRPGASLKLSCKASGYTFTSYWMHWVRQRPGQGLEWIGNSYPGDLNVNYDEKFKNKVTLAVDTSSSTAFLQLSSLTSEDSAVYYCTRDAYSRYFFDYWGQGTTLTVSS

SEQ ID NO: 5426 - protein, 119 aa, Artificial Sequence
  Description of Artificial Sequence: Synthetic polypeptide
QVQLQQSGPEMVKPGASVTISCKTSGFTFTSYYIHWMMQRPGQGLEWIGWLYPGDVSTRYNEKFRDKATLTADKSSTTAYLYLSSLTSEDSAVYFCARDSSASYYFDFWGQGTTLTVSS

SEQ ID NO: 5427 - protein, 119 aa, Artificial Sequence
  Description of Artificial Sequence: Synthetic polypeptide
QVQLQQPGSELVRPGASVTLSCTASGYSFTSYWMHWVKQRPGQGLEWVGNIYPGGEIINYAEKFKTKGTLTVDISSSTAYMHLSSLTSDDSAVYYCTRDTTGNYFFDYWGQGTTLTVSS

SEQ ID NO: 5428 - protein, 116 aa, Artificial Sequence
  Description of Artificial Sequence: Synthetic polypeptide
QSVKESEGGLFKPTDTLTLTCTVSGCSLSSCAISWVRQAPGKGLEWIGFMSVTGSAYYANWAKSRSTITRNTNENTVTLKMTRLTAADTAIYFCARVGIGSGLNIWGQGTLVTVSS

SEQ ID NO: 5429 - protein, 118 aa, Artificial Sequence; identical to SEQ ID NO: 4683
  Description of Artificial Sequence: Synthetic polypeptide

SEQ ID NO: 5430 - protein, 122 aa, Artificial Sequence
  Description of Artificial Sequence: Synthetic polypeptide
DVQLVESGGGLVQPGGSRKLSCAASGFTFSSFGMHWVRQAPEKGLEWVAYISSDSSAIYYADTVKGRFTISRDNPKNTLFLQMTSLRSEDTAMYYCGRGRENIYYGSRLDYWGQGTTLTVSS

SEQ ID NO: 5431 - protein, 120 aa, Artificial Sequence
  Description of Artificial Sequence: Synthetic polypeptide
QVQLQQSGAELARPGASVKLSCKASGYTFTSYWMQWVKQRPGQGLEWIGTIYPGDGDTRYTQKFKGKATLTADKSSSTAYMQLSSLASEDSAVYYCARRGIPRLWYFDVWGAGTTVTVSS

SEQ ID NO: 5432 - protein, 117 aa, Artificial Sequence
  Description of Artificial Sequence: Synthetic polypeptide
EVQQVESGGDLVKPGGSLKLSCAASGFTFSSYGMSWVRQTPDKRLEWVATINSGGSNTYYPDSLKGRFTISRDNAKNTLYLQMRSLKSEDTAMYYCARHDGGAMDYWGQGTSVTVSS

SEQ ID NO: 5433 - protein, 122 aa, Artificial Sequence
  Description of Artificial Sequence: Synthetic polypeptide
  MOD_RES (13)..(13): Any amino acid
QVQLVQSGAEVKXPGASVKVSCKASGHIFSNYWIQWVRQAPGQGLEWMGEILPGSGHTEYTENFKDRVTMTRDTSTSTVYMELSSLRSEDTAVYYCARYFFGSSPNWYFDVWGQGTLVTVSS

SEQ ID NO: 5434 - protein, 118 aa, Artificial Sequence
  Description of Artificial Sequence: Synthetic polypeptide
EVHLQESGPSLVKPSQTLSLTCSVTGDSITNGYWNWIRKFPGNKLDYMGYISYDGNTYYNPSLKSRFSITRDTSKNQYYLQLNSVTTEDTATYYCSRGDYGTYVMDYWGQGTSVTVSS

SEQ ID NO: 5435 - protein, 115 aa, Artificial Sequence
  Description of Artificial Sequence: Synthetic polypeptide
QVQLQQPGAELVKPGASVKMSCKASGYTFTSYNIHWVKQTPGQGLEWIGAVSPRNGDTSYNQRFKGKATLTADISSSTAYMQLSSLTSEDSAVYYCARGYGYDYWGQGTTLTVSS

SEQ ID NO: 5436 - protein, 120 aa, Artificial Sequence
  Description of Artificial Sequence: Synthetic polypeptide
QVQLKESGPGLVAPSQSLSITCTVSGFSLTGYGIHWVRQPPGKGLEWLGVIWPGGGTNYNSALMSRLSISKDNSKSQVFLKMNSLQTDDTAMYYCARGPLITTEVSMDYWGQGTSVTVSS

SEQ ID NO: 5437 - protein, 120 aa, Artificial Sequence
  Description of Artificial Sequence: Synthetic polypeptide
QVQLKESGPGLVAPSQSLSITCTVSGFSLTGYGIHWVRQPPGKGLEWLGVIWPGGGTNYNSALMSRLNISKDNSKSQVFLKMNSLQTDDTAMYYCARGPLITTEVSMDYWGQGTSVTVSS

SEQ ID NO: 5438 - protein, 119 aa, Artificial Sequence
  Description of Artificial Sequence: Synthetic polypeptide
EVQLVQSGAEVKKPGESLKISCKGSGFNIKDTYIHWVRQMPGKGLEWIGRIDPANGNTQYDPKFQGKATISADTSISTAYLQWSSLKASDTAMYYCARRWDYDYAMDYWGQGTTVTVSS

SEQ ID NO: 5439 - protein, 120 aa, Artificial Sequence
  Description of Artificial Sequence: Synthetic polypeptide
EVQLVESGGGLVQPGGSLRLSCAASGFSLTGYAMHWVRQAPGKGLEWVGVIWPGGGTNYNSALMSRFTISKDNSKNTVYLQMNSLRAEDTAVYYCARGPLITTEVSMDYWGQGTLVTVSS

SEQ ID NO: 5440 - protein, 119 aa, Artificial Sequence
  Description of Artificial Sequence: Synthetic polypeptide
EVQLQQSGAELVKPGASVKLSCTASGFNIKDTYIHWVKQRPEQGLEWIGRIDPANGNTQYDPKFQGKATITADTSSNTAYLQLTSLTSEDTAVYYCARRWDYDYAMDYWGQGTSVTVSS

SEQ ID NO: 5441 - protein, 124 aa, Artificial Sequence
  Description of Artificial Sequence: Synthetic polypeptide
EFEVQLQESGPELVKPGASVKMSCKASGYTFTSYVMHWVKQKPGQGLEWIGYFNPYNDGTDYYEKFKGKATLTSDKSSSTAYMALSSLTSEDSAVYYCARGTYYYGSSYPFDYWGQGTTLTVSS

SEQ ID NO: 5442 - protein, 123 aa, Artificial Sequence
  Description of Artificial Sequence: Synthetic polypeptide
EFEVQLQESGPELVKPGASVKISCKASGYAFSSSWMNWVIQRPGQGLEWIGRIYPGDGDTNYNGKFKGKATLTADKSSSTAYMQLSSLTSVDSAVYFCARSGFITTVLDFDYWGHGTTLTVSS

SEQ ID NO: 5443 - protein, 121 aa, Artificial Sequence
  Description of Artificial Sequence: Synthetic polypeptide
EVQLQQSGPELIKPGASVKMSCKASGYTFTSYVMHWVKQKPGQGLEWIGYINPYNDGTKYNEKFKGKATLTSDKSSSTAYMALSSLTSEDSAVYYCARGTYYYGSRVFDYWGQGTTLTVSS

SEQ ID NO: 5444 - protein, 124 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSS

SEQ ID NO: 5445 - protein, 124 aa, Artificial Sequence
  Description of Artificial Sequence: Synthetic polypeptide
QVQLLESGAELVRPGSSVKISCKASGYAFSSYWMNWVKQRPGQGLEWIGQIWPGDGDTNYNGKFKGKATLTADESSSTAYMQLSSLRSEDSAVYSCARRETTTVGRYYYAMDYWGQGTTVTVSS

SEQ ID NO: 5446 - protein, 121 aa, Artificial Sequence
  Description of Artificial Sequence: Synthetic polypeptide
EVKLQESGPGLVAPSQSLSVTCTVSGVSLPDYGVSWIRQPPRKGLEWLGVIWGSEDTTYYNSALKSRLTIIKDNSKSQVFLKMNSLQTDDTAIYYCAKHYYYGGSYAMDYWGQGTSVTVSS

SEQ ID NO: 5447 - protein, 121 aa, Artificial Sequence
  Description of Artificial Sequence: Synthetic polypeptide
EVQLVESGGGLVQPGGSLRLSCAASGFTFSSSWMNWVRQAPGKGLEWVGRIYPGDGDTNYNVKFKGRFTISRDDSKNSLYLQMNSLKTEDTAVYYCARSGFITTVRDFDYWGQGTLVTVSS

SEQ ID NO: 5448 - protein, 124 aa, Artificial Sequence
  Description of Artificial Sequence: Synthetic polypeptide
QVQLQQSGAEVKKPGSSVKVSCKASGYAFSSYWMNWVRQRPGQGLEWIGQIWPGDGDTNYNGKFKGRATITADESTNTAYMELSSLRSEDTAFYSCARRETTTVGRYYYAMDYWGQGTTVTVSS

SEQ ID NO: 5449 - protein, 124 aa, Artificial Sequence; identical to SEQ ID NO: 5448
  Description of Artificial Sequence: Synthetic polypeptide

SEQ ID NO: 5450 - protein, 124 aa, Artificial Sequence
  Description of Artificial Sequence: Synthetic polypeptide
QVQLQESGAELVRPGSSVKISCKASGYAFSSYWMNWVKQRPGQGLEWIGQIWPGDGDTNYNGKFKGKATLTADESSSTAYMQLSSLRSEDSAVYSCARRETTTVGRYYYAMDYWGQGTTVTVSS

SEQ ID NO: 5451 - protein, 117 aa, Artificial Sequence
  Description of Artificial Sequence: Synthetic polypeptide
QVQLVQSGAEVKKPGSSVKVSCKASGGTFSSYWLHWVRQAPGQGLEWMGGIVPMFGPPNYAQKFQGRATITADESTNTAYMELSSLRSEDTAFYFCAGGYGIYSPEWGQGSLVTVSS

SEQ ID NO: 5452 - protein, 124 aa, Artificial Sequence; identical to SEQ ID NO: 5450
  Description of Artificial Sequence: Synthetic polypeptide

SEQ ID NO: 5453 - protein, 124 aa, Artificial Sequence; identical to SEQ ID NO: 5448
  Description of Artificial Sequence: Synthetic polypeptide

SEQ ID NO: 5454 - protein, 117 aa, Artificial Sequence; identical to SEQ ID NO: 5451
  Description of Artificial Sequence: Synthetic polypeptide

SEQ ID NO: 5455 - protein, 105 aa, Artificial Sequence
  Description of Artificial Sequence: Synthetic polypeptide
DIQLTQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEI

SEQ ID NO: 5456 - protein, 106 aa, Artificial Sequence
  Description of Artificial Sequence: Synthetic polypeptide
DIQLTQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 5457 - protein, 122 aa, Artificial Sequence [sequence omitted]

SEQ ID NO: 5458 - protein, 266 aa, Artificial Sequence
  Description of Artificial Sequence: Synthetic polypeptide
MDFQVQIFSFLLISASVIIARGQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKDGGGSGGGGSGGGGSSQAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSD

SEQ ID NO: 5459 - protein, 121 aa, Artificial Sequence
  Description of Artificial Sequence: Synthetic polypeptide
QVQLQQPGAELVRPGTSVKLSCKASGYTFTSYWMHWIKQRPGQGLEWIGVIDPSDNYTKYNQKFKGKATLTVDTSSSTAYMQLSSLTSEDSAVYFCAREGYYGSSPWFAYWGQGTLVTVSS

SEQ ID NO: 5460 - protein, 122 aa, Artificial Sequence
  Description of Artificial Sequence: Synthetic polypeptide
EVQLVESGGGLVQPGRSLRLSCAASGFTFYDYAMHWVRQAPGKGLEWVSGISWNSGYIGYADSVKGRFTISRDNAKNSLYLQMNSLRAEDTALYYCAKDNSYGKFYYGLDVWGQGTTVTVSS

SEQ ID NO: 5461 - protein, 122 aa, Artificial Sequence; identical to SEQ ID NO: 5460
  Description of Artificial Sequence: Synthetic polypeptide

SEQ ID NO: 5462 - protein, 128 aa, Artificial Sequence
  Description of Artificial Sequence: Synthetic polypeptide
QVQLVQSGAEVKKPGASVKVSCEASGYTFNSYGISWVRQAPGQGLEWMGWIRTYNGNTNYAQKLQGRVTMTTDTSTSTAYMELRSLRSDDTAVYYCARDEARIVVAGTTPYYYGMDVWGQGTTVTVSS

SEQ ID NO: 5463 - protein, 128 aa, Artificial Sequence
  Description of Artificial Sequence: Synthetic polypeptide
QVQLVQSGAEVKKPGASVKVSCKASGYTFNSYGISWVRQAPGQGLEWMGWIRTYNGNTNYAQKLQGRVTMTTDTSTSTAYMELRSLRSDDTAVYYCARDEARIVVAGTTPYYYGMDVWGQGTTVTVSS

SEQ ID NO: 5464 - protein, 126 aa, Artificial Sequence
  Description of Artificial Sequence: Synthetic polypeptide
EVQLVESGGGLVQPGRSLRLSCAASGFTFHDYTMHWVRQAPGKGLEWVSGISWNSGSIGYADSVKGRFTISRDNAKNSLYLQMNSLRIEDTALYYCAKDPSYGSGSYYYYYGMDVWGQGTTVTVSS

SEQ ID NO: 5465 - protein, 126 aa, Artificial Sequence
  Description of Artificial Sequence: Synthetic polypeptide
EVQLVESGGGLVQPGRSLRLSCAASGFTFHDYTMHWVRQAPGKGLEWVSGISWNSGSIGYADSVKGRFTISRDNAKNSLYLQMNSLRAEDTALYYCAKDPSYGSGSYYYYYGMDVWGQGTTVTVSS

SEQ ID NO: 5466 - protein, 123 aa, Artificial Sequence
  Description of Artificial Sequence: Synthetic polypeptide
EVQLVESGGGLVQPGRSLRLSCAASGFTFRDYAMHWVRQGPGKGLEWVSGISWNTDYIGYADSVKGRFTISRDNAKNSLYLQMNSLRPEDTALYYCAKDARYGRDNYYGMDVWGQGTTVTVSS

SEQ ID NO: 5467 - protein, 127 aa, Artificial Sequence
  Description of Artificial Sequence: Synthetic polypeptide
EVQLVESGGGLVQPGRSLRLSCVASGFTFNDYAMHWVRQAPGKGLEWVSVISWNSDSIGYADSVKGRFTISRDNAKNSLYLQMHSLRAEDTALYYCAKDNHYGSGSYYYYQYGMDVWGQGTTVTVSS

SEQ ID NO: 5468 - protein, 123 aa, Artificial Sequence
  Description of Artificial Sequence: Synthetic polypeptide
EVQLVESGGGLVQPGRSLRLSCAASGFTFRDYAMHWVRQAPGKGLEWVSGISWNTDYIGYADSVKGRFTISRDNAKNSLYLQMNSLRAEDTALYYCAKDARYGRDNYYGMDVWGQGTTVTVSS

SEQ ID NO: 5469 - protein, 123 aa, Artificial Sequence
  Description of Artificial Sequence: Synthetic polypeptide
EVQLVESGGGLVQSGRSLRLSCAASGITFHDYAMHWVRQPPGKGLEWVSGISWNSDYIGYADSVKGRFTISRDNAKKSLYLQMNSLRPDDTALYYCVKDFHYGSGSNYGMDVWGQGTTVTVSS

SEQ ID NO: 5470 - protein, 123 aa, Artificial Sequence
  Description of Artificial Sequence: Synthetic polypeptide
EVQLVESGGGLVQPGRSLRLSCAASGITFHDYAMHWVRQAPGKGLEWVSGISWNSDYIGYADSVKGRFTISRDNAKNSLYLQMNSLRAEDTALYYCVKDFHYGSGSNYGMDVWGQGTTVTVSS

SEQ ID NO: 5471 - protein, 127 aa, Artificial Sequence
  Description of Artificial Sequence: Synthetic polypeptide
EVQLVESGGGLVQPGRSLRLSCAASGFTFNDYAMHWVRQAPGKGLEWVSGISWNSDSIGYADSVKGRFTISRDNAKNSLYLQMNSLRAEDTALYYCAKDNHYGSGSYYYYQYGMDVWGQGTTVTVSS

SEQ ID NO: 5472 - protein, 127 aa, Artificial Sequence
  Description of Artificial Sequence: Synthetic polypeptide
EVQLVESGGGLVQPGRSLRLSCAASGFSFHDYAMHWVRQAPGKGLEWVSGISWNSDSLGYADSVKGRFTISRDNAKNSLYLQMNSLRAEDTALYYCAKDNHYGSGSHYYYKYGMDVWGQGTTVTVSS

SEQ ID NO: 5473 - protein, 127 aa, Artificial Sequence; identical to SEQ ID NO: 5472
  Description of Artificial Sequence: Synthetic polypeptide

SEQ ID NO: 5474 - protein, 122 aa, Artificial Sequence
  Description of Artificial Sequence: Synthetic polypeptide
EVQLVESGGGLVQPGRSLRLSCAASGFTFYDYAMHWVRQAPGKGLEWVSGISWNSDTIGYADSVKGRFTISRDNAKNSLYLQMNSLRAEDTALYYCTKDGSYGHFYSGLDVWGQGTTVTVSS

SEQ ID NO: 5475 - protein, 122 aa, Artificial Sequence; identical to SEQ ID NO: 5474
  Description of Artificial Sequence: Synthetic polypeptide

SEQ ID NO: 5476 - protein, 123 aa, Artificial Sequence
  Description of Artificial Sequence: Synthetic polypeptide
EVQLVESGGGLVQPGRSLRLSCAASGFTFYDYAMHWVRQAPGKGLEWVSGISWNSDYIGYADSVKGRFTISRDNAKNSLYLQMNSLRAEDTALYYCAKDARYGRNNYYGMDVWGQGTTVTVSS

SEQ ID NO: 5477 - protein, 123 aa, Artificial Sequence; identical to SEQ ID NO: 5476
  Description of Artificial Sequence: Synthetic polypeptide

SEQ ID NO: 5478 - protein, 123 aa, Artificial Sequence
  Description of Artificial Sequence: Synthetic polypeptide
EVQLVESGGGLVQPGRSLRLSCAASGFTFDDYAMHWVRQVPGKGLEWVSGISWNSGSIGYADSVKGRFTISRDNAKNSLYLQMNSLRAEDTALYYCAKDMGYGNYYHYGMDVWGQGTTVTVSS

SEQ ID NO: 5479 - protein, 123 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDMGYGNYYHYGMDVWGQGTTVTVSS

SEQ ID NO: 5480 - protein, 123 aa, Artificial Sequence
  Description of Artificial Sequence: Synthetic polypeptide
EVQLVESGGGLVQPGRSLRLSCAASGFTFRDYAMHWVRQVPGKGLEWVSGISWNRGTIGYADSVKGRFTISRDNAKNSLFLQMNSLRADDTALYYCAKDHYYGSGSPYGMDVWGQGTTVTVSS

SEQ ID NO: 5481 - protein, 123 aa, Artificial Sequence
  Description of Artificial Sequence: Synthetic polypeptide
EVQLVESGGGLVQPGRSLRLSCAASGFTFRDYAMHWVRQAPGKGLEWVSGISWNRGTIGYADSVKGRFTISRDNAKNSLYLQMNSLRAEDTALYYCAKDHYYGSGSPYGMDVWGQGTTVTVSS

SEQ ID NO: 5482 - protein, 126 aa, Artificial Sequence
  Description of Artificial Sequence: Synthetic polypeptide
EVQLVESGGGLVQPGRSLRLSCAASGFTFHDYTMHWVRQAPGKGLEWVSGISWNSGSLGYADSVKGRFTISRDNAKKSLYLQMNSLRAEDTALYYCAKDPSYGSGSYHSYYGMDVWGQGTTVTVSS

SEQ ID NO: 5483 - protein, 126 aa, Artificial Sequence
  Description of Artificial Sequence: Synthetic polypeptide
EVQLVESGGGLVQPGRSLRLSCAASGFTFHDYTMHWVRQAPGKGLEWVSGISWNSGSLGYADSVKGRFTISRDNAKNSLYLQMNSLRAEDTALYYCAKDPSYGSGSYHSYYGMDVWGQGTTVTVSS

SEQ ID NO: 5484 - protein, 127 aa, Artificial Sequence
  Description of Artificial Sequence: Synthetic polypeptide
EVQLVESGGGLVQPGRSLRLSCTASGFTFGDFPMHWVRQAPGKGLEWVSGITWNSGSIVYADSVKGRFTISRDNAKNSLYLQMNSLRTEDTALYYCAKDSHYGSGNFYYYYYGMDVWGQGTTVTVSS

SEQ ID NO: 5485 - protein, 127 aa, Artificial Sequence
  Description of Artificial Sequence: Synthetic polypeptide
EVQLVESGGGLVQPGRSLRLSCAASGFTFGDFPMHWVRQAPGKGLEWVSGITWNSGSIGYADSVKGRFTISRDNAKNSLYLQMNSLRAEDTALYYCAKDSHYGSGNFYYYYYGMDVWGQGTTVTVSS

SEQ ID NO: 5486 - protein, 122 aa, Artificial Sequence
  Description of Artificial Sequence: Synthetic polypeptide
QVQLVESGGGLVKPGGSLRLSCAASGFTFSDSYMTWIRQAPGKGLEWVSFISSSGSTIYYADSVKGRFTISRDNVKKSLYLQMNRLRAEDTAVYYCAREEPGNYVYYGMDVWGQGTTVTVSS

SEQ ID NO: 5487 - protein, 122 aa, Artificial Sequence
  Description of Artificial Sequence: Synthetic polypeptide
QVQLVESGGGLVKPGGSLRLSCAASGFTFSDSYMSWIRQAPGKGLEWVSYISSSGSTIYYADSVKGRFTISRDNAKNSLYLQMNSLRAEDTAVYYCAREEPGNYVYYGMDVWGQGTTVTVSS

SEQ ID NO: 5488 - protein, 123 aa, Artificial Sequence
  Description of Artificial Sequence: Synthetic polypeptide
EVQLVESGGGLVQPGRSLRLSCAASGFTFRDYTMHWVRQGPGKGLEWVSGISWNSDYIGYADSVKGRFTISRDNAKNSLYLQMNSLRVEDTALYYCAKLSGTYRDYFYGVDVWGQGTTVTVSS

SEQ ID NO: 5489 - protein, 123 aa, Artificial Sequence
  Description of Artificial Sequence: Synthetic polypeptide
EVQLVESGGGLVQPGRSLRLSCAASGFTFRDYTMHWVRQAPGKGLEWVSGISWNSDYIGYADSVKGRFTISRDNAKNSLYLQMNSLRAEDTALYYCAKLSGTYRDYFYGVDVWGQGTTVTVSS

SEQ ID NO: 5490 - protein, 123 aa, Artificial Sequence; identical to SEQ ID NO: 5466
  Description of Artificial Sequence: Synthetic polypeptide

SEQ ID NO: 5491 - protein, 123 aa, Artificial Sequence; identical to SEQ ID NO: 5468
  Description of Artificial Sequence: Synthetic polypeptide

SEQ ID NO: 5492 - protein, 122 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 5493 - protein, 140 aa, Artificial Sequence; identical to SEQ ID NO: 5268
  Description of Artificial Sequence: Synthetic polypeptide

SEQ ID NO: 5494 - protein, 125 aa, Artificial Sequence
  Description of Artificial Sequence: Synthetic polypeptide
EVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSS

SEQ ID NO: 5495 - protein, 122 aa, Artificial Sequence; identical to SEQ ID NO: 5368
  Description of Artificial Sequence: Synthetic polypeptide

SEQ ID NO: 5496 - protein, 112 aa, Artificial Sequence
  Description of Artificial Sequence: Synthetic polypeptide
GPELVKPGASVKISCKASGYAFSYSWMNWVKLRPGQGLEWIGRIFPGDGDTDYNGKFKGKATLTADKSSNTAYMQLTSLTSVDSAVYLCARNVFDGYWLVYWGQGTLVTVSA

SEQ ID NO: 5497 - protein, 119 aa, Artificial Sequence
  Description of Artificial Sequence: Synthetic polypeptide
QVQLVQSGAEVKKPGSSVKVSCKASGYAFSYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5498 - protein, 119 aa, Artificial Sequence
  Description of Artificial Sequence: Synthetic polypeptide
QVQLVQSGAEVKKPGSSVKVSCKASGYAFSYSWMNWVRQAPGQGLEWMGRIFPGDGDTDYNGKFKGRVTITADKSTSTAYMELSSLRSEDTAVYLCARNVFDGYWLVYWGQGTLVTVSS

SEQ ID NO: 5499 - protein, 119 aa, Artificial Sequence
  Description of Artificial Sequence: Synthetic polypeptide
QVQLVQSGAEVKKPGASVKVSCKVSGYAFSYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5500 - protein, 119 aa, Artificial Sequence
  Description of Artificial Sequence: Synthetic polypeptide
QVQLVQSGAEVKKPGSSVKVSCKASGYAFSYSWMSWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5501 - protein, 119 aa, Artificial Sequence; identical to SEQ ID NO: 5166
  Description of Artificial Sequence: Synthetic polypeptide

SEQ ID NO: 5502 - protein, 119 aa, Artificial Sequence
  Description of Artificial Sequence: Synthetic polypeptide
QVQLVQSGAEVKKPGSSVKVSCKASGYAFSYSWISWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5503 - protein, 119 aa, Artificial Sequence
  Description of Artificial Sequence: Synthetic polypeptide
QVQLVQSGAEVKKPGASVKVSCKASGYTFTYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5504 - protein, 119 aa, Artificial Sequence
  Description of Artificial Sequence: Synthetic polypeptide
QVQLVQSGAEVKKPGASVKVSCKASGYTFSYSWMNWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 5505 - protein, 119 aa, Artificial Sequence
  Description of Artificial Sequence: Synthetic polypeptide
EVQLVESGGGLVKPGGSLRLSCAASGFTFSYSWMNWVRQAPGKGLEWVGRIFPGDGDTDYNGKFKGRVTITADKSTSTAYMELSSLRSEDTAVYYCARNVFDGYWLVYWGQGTLVTVSS

SEQ ID NO: 5506 - protein, 119 aa, Artificial Sequence
  Description of Artificial Sequence: Synthetic polypeptide
EVQLVESGGGLVKPGGSLRLSCAASGFAFSYSWMNWVRQAPGKGLEWVGRIFPGDGDTDYNGKFKGRVTITADKSTSTAYMELSSLRSEDTAVYYCARNVFDGYWLVYWGQGTLVTVSS

SEQ ID NO: 5507 - protein, 119 aa, Artificial Sequence
  Description of Artificial Sequence: Synthetic polypeptide
QVQLVESGGGLVKPGGSLRLSCAASGFTFSYSWMNWVRQAPGKGLEWVGRIFPGDGDTDYNGKFKGRVTITADKSTSTAYMELSSLRSEDTAVYYCARNVFDGYWLVYWGQGTLVTVSS

SEQ ID NO: 5508 - protein, 119 aa, Artificial Sequence
  Description of Artificial Sequence: Synthetic polypeptide
EVQLVESGAGLVKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 5509 - protein, 119 aa, Artificial Sequence
  Description of Artificial Sequence: Synthetic polypeptide
EVQLVESGGGVVKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 5510 - protein, 119 aa, Artificial Sequence
  Description of Artificial Sequence: Synthetic polypeptide
EVQLVESGGGLKKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 5511 - protein, 119 aa, Artificial Sequence
  Description of Artificial Sequence: Synthetic polypeptide
EVQLVESGGGLVKPGSSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 5512 - protein, 119 aa, Artificial Sequence
  Description of Artificial Sequence: Synthetic polypeptide
EVQLVESGGGLVKPGGSLRVSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 5513 - protein, 119 aa, Artificial Sequence
  Description of Artificial Sequence: Synthetic polypeptide
EVQLVESGGGLVKPGGSLRLSCAASGFTFSYSWMNWVRQAPGKGLEWMGRIFPGDGDTDYNGKFKGRVTITADKSTSTAYMELSSLRSEDTAVYYCARNVFDGYWLVYWGQGTLVTVSS

SEQ ID NO: 5514 - protein, 119 aa, Artificial Sequence; identical to SEQ ID NO: 5166
  Description of Artificial Sequence: Synthetic polypeptide

SEQ ID NO: 5515 - protein, 122 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSS

SEQ ID NO: 5516 - protein, 122 aa, Artificial Sequence [sequence omitted]

SEQ ID NO: 5517 - protein, 123 aa, Artificial Sequence
  Description of Artificial Sequence: Synthetic polypeptide
AVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSS

SEQ ID NO: 5518 - protein, 140 aa, Artificial Sequence
  Description of Artificial Sequence: Synthetic polypeptide
MELGLSWIFLLAILKGVQCEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVS

SEQ ID NO: 5519 - protein, 121 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFDVWGQGTTVTVSS

SEQ ID NO: 5520 - protein, 140 aa, Artificial Sequence; identical to SEQ ID NO: 5268
  Description of Artificial Sequence: Synthetic polypeptide

SEQ ID NO: 5521 - protein, 122 aa, Artificial Sequence; identical to SEQ ID NO: 5460
  Description of Artificial Sequence: Synthetic polypeptide

SEQ ID NO: 5522 - protein, 122 aa, Artificial Sequence; identical to SEQ ID NO: 5460
  Description of Artificial Sequence: Synthetic polypeptide

SEQ ID NO: 5523 - protein, 128 aa, Artificial Sequence
  Description of Artificial Sequence: Synthetic polypeptide
QVQLVESGAEVKKPGASVKVSCEASGYTFNSYGISWVRQAPGQGLEWMGWIRTYNGNTNYAQKLQGRVTMTTDTSTSTAYMELRSLRSDDTAVYYCARDEARIVVAGTTPYYYGMDVWGQGTTVTVSS

SEQ ID NO: 5524 - protein, 128 aa, Artificial Sequence; identical to SEQ ID NO: 5462
  Description of Artificial Sequence: Synthetic polypeptide

SEQ ID NO: 5525 - protein, 128 aa, Artificial Sequence; identical to SEQ ID NO: 5463
  Description of Artificial Sequence: Synthetic polypeptide

SEQ ID NO: 5526 - protein, 126 aa, Artificial Sequence
  Description of Artificial Sequence: Synthetic polypeptide
EEQLVESGGDLVQPGRSLRLSCAASGFTFHDYTMHWVRQAPGKGLEWVSGISWNSGSIGYADSVKGRFTISRDNAKNSLYLQMNSLRIEDTALYYCAKDPSYGSGSYYYYYGMDVWGQGTTVTVSS

SEQ ID NO: 5527 - protein, 126 aa, Artificial Sequence; identical to SEQ ID NO: 5464
  Description of Artificial Sequence: Synthetic polypeptide

SEQ ID NO: 5528 - protein, 126 aa, Artificial Sequence; identical to SEQ ID NO: 5465
  Description of Artificial Sequence: Synthetic polypeptide

SEQ ID NO: 5529 - protein, 123 aa, Artificial Sequence
  Description of Artificial Sequence: Synthetic polypeptide
AVQLVESGGGLVQPGRSLRLSCAASGFTFRDYAMHWVRQGPGKGLEWVSGISWNTDYIGYADSVKGRFTISRDNAKNSLYLQMNSLRPEDTALYYCAKDARYGRDNYYGMDVWGQGTTVTVSS

SEQ ID NO: 5530 - protein, 123 aa, Artificial Sequence; identical to SEQ ID NO: 5466
  Description of Artificial Sequence: Synthetic polypeptide

SEQ ID NO: 5531 - protein, 127 aa, Artificial Sequence; identical to SEQ ID NO: 5467
  Description of Artificial Sequence: Synthetic polypeptide

SEQ ID NO: 5532 - protein, 123 aa, Artificial Sequence; identical to SEQ ID NO: 5468
  Description of Artificial Sequence: Synthetic polypeptide

SEQ ID NO: 5533 - protein, 123 aa, Artificial Sequence
  Description of Artificial Sequence: Synthetic polypeptide
EVQLAESGGDLVQSGRSLRLSCAASGITFHDYAMHWVRQPPGKGLEWVSGISWNSDYIGYADSVKGRFTISRDNAKKSLYLQMNSLRPDDTALYYCVKDFHYGSGSNYGMDVWGQGTTVTVSP

SEQ ID NO: 5534 - protein, 123 aa, Artificial Sequence; identical to SEQ ID NO: 5469
  Description of Artificial Sequence: Synthetic polypeptide

SEQ ID NO: 5535 - protein, 123 aa, Artificial Sequence; identical to SEQ ID NO: 5470
  Description of Artificial Sequence: Synthetic polypeptide

SEQ ID NO: 5536 - protein, 127 aa, Artificial Sequence; identical to SEQ ID NO: 5472
  Description of Artificial Sequence: Synthetic polypeptide

SEQ ID NO: 5537 - protein, 127 aa, Artificial Sequence; identical to SEQ ID NO: 5471
  Description of Artificial Sequence: Synthetic polypeptide

SEQ ID NO: 5538 - protein, 127 aa, Artificial Sequence; identical to SEQ ID NO: 5472
  Description of Artificial Sequence: Synthetic polypeptide

SEQ ID NO: 5539 - protein, 127 aa, Artificial Sequence; identical to SEQ ID NO: 5472
  Description of Artificial Sequence: Synthetic polypeptide

SEQ ID NO: 5540 - protein, 122 aa, Artificial Sequence; identical to SEQ ID NO: 5474
  Description of Artificial Sequence: Synthetic polypeptide

SEQ ID NO: 5541 - protein, 122 aa, Artificial Sequence; identical to SEQ ID NO: 5474
  Description of Artificial Sequence: Synthetic polypeptide

SEQ ID NO: 5542 - protein, 122 aa, Artificial Sequence; identical to SEQ ID NO: 5474
  Description of Artificial Sequence: Synthetic polypeptide

SEQ ID NO: 5543 - protein, 123 aa, Artificial Sequence
  Description of Artificial Sequence: Synthetic polypeptide
EVQLVESGGGLVQPGRSLRLSCAASGFTFYDYAMHWVRQAPGKGLEWVSGISWNSDYIGYADSVKGRFTISRDNAKNSLYLQMNSLRAEDTALYYCAKDARYGRNNYYGMDVWGPGTTVTVSS

SEQ ID NO: 5544 - protein, 122 aa, Artificial Sequence
  Description of Artificial Sequence: Synthetic polypeptide
QVQLVESGGDSVKPGGSLRLSCAASGFTFSDSYMTWIRQAPGKGLEWVSFISSSGSTIYYADSVKGRFTISRDNVKKSLYLQMNRLRAEDTAVYYCAREEPGNYVYYGMDVWGQGTTVTVSS

SEQ ID NO: 5545 - protein, 123 aa, Artificial Sequence; identical to SEQ ID NO: 5476
  Description of Artificial Sequence: Synthetic polypeptide

SEQ ID NO: 5546 - protein, 123 aa, Artificial Sequence; identical to SEQ ID NO: 5476
  Description of Artificial Sequence: Synthetic polypeptide

SEQ ID NO: 5547 - protein, 123 aa, Artificial Sequence; identical to SEQ ID NO: 5478
  Description of Artificial Sequence: Synthetic polypeptide

SEQ ID NO: 5548 - protein, 127 aa, Artificial Sequence; identical to SEQ ID NO: 5467
  Description of Artificial Sequence: Synthetic polypeptide

SEQ ID NO: 5549 - protein, 123 aa, Artificial Sequence; identical to SEQ ID NO: 5478
  Description of Artificial Sequence: Synthetic polypeptide

SEQ ID NO: 5550 - protein, 123 aa, Artificial Sequence; identical to SEQ ID NO: 5479
  Description of Artificial Sequence: Synthetic polypeptide

SEQ ID NO: 5551 - protein, 123 aa, Artificial Sequence; identical to SEQ ID NO: 5480
  Description of Artificial Sequence: Synthetic polypeptide

SEQ ID NO: 5552 - protein, 123 aa, Artificial Sequence; identical to SEQ ID NO: 5480
  Description of Artificial Sequence: Synthetic polypeptide

SEQ ID NO: 5553 - protein, 123 aa, Artificial Sequence; identical to SEQ ID NO: 5481
  Description of Artificial Sequence: Synthetic polypeptide

SEQ ID NO: 5554 - protein, 126 aa, Artificial Sequence
  Description of Artificial Sequence: Synthetic polypeptide
EEQLVESGGDLVQPGRSLRLSCAASGFTFHDYTMHWVRQAPGKGLEWVSGISWNSGSLGYADSVKGRFTISRDNAKKSLYLQMNSLRAEDTALYYCAKDPSYGSGSYHSYYGMDVWGQGTTVTVSS

SEQ ID NO: 5555 - protein, 126 aa, Artificial Sequence; identical to SEQ ID NO: 5482
  Description of Artificial Sequence: Synthetic polypeptide

SEQ ID NO: 5556 - protein, 126 aa, Artificial Sequence; identical to SEQ ID NO: 5483
  Description of Artificial Sequence: Synthetic polypeptide

SEQ ID NO: 5557 - protein, 127 aa, Artificial Sequence; identical to SEQ ID NO: 5484
  Description of Artificial Sequence: Synthetic polypeptide

SEQ ID NO: 5558 - protein, 127 aa, Artificial Sequence; identical to SEQ ID NO: 5484
  Description of Artificial Sequence: Synthetic polypeptide

SEQ ID NO: 5559 - protein, 127 aa, Artificial Sequence; identical to SEQ ID NO: 5485
  Description of Artificial Sequence: Synthetic polypeptide

SEQ ID NO: 5560 - protein, 122 aa, Artificial Sequence; identical to SEQ ID NO: 5486
  Description of Artificial Sequence: Synthetic polypeptide

SEQ ID NO: 5561 - protein, 122 aa, Artificial Sequence; identical to SEQ ID NO: 5487
  Description of Artificial Sequence: Synthetic polypeptide

SEQ ID NO: 5562 - protein, 123 aa, Artificial Sequence; identical to SEQ ID NO: 5488
  Description of Artificial Sequence: Synthetic polypeptide

SEQ ID NO: 5563 - protein, 123 aa, Artificial Sequence; identical to SEQ ID NO: 5488
  Description of Artificial Sequence: Synthetic polypeptide

SEQ ID NO: 5564 - protein, 123 aa, Artificial Sequence; identical to SEQ ID NO: 5489
  Description of Artificial Sequence: Synthetic polypeptide

SEQ ID NO: 5565 - protein, 123 aa, Artificial Sequence; identical to SEQ ID NO: 5466
  Description of Artificial Sequence: Synthetic polypeptide

SEQ ID NO: 5566 - protein, 123 aa, Artificial Sequence; identical to SEQ ID NO: 5466
  Description of Artificial Sequence: Synthetic polypeptide

SEQ ID NO: 5567 - protein, 123 aa, Artificial Sequence; identical to SEQ ID NO: 5468
  Description of Artificial Sequence: Synthetic polypeptide

SEQ ID NO: 5568 - protein, 122 aa, Artificial Sequence; identical to SEQ ID NO: 5460
  Description of Artificial Sequence: Synthetic polypeptide

SEQ ID NO: 5569 - protein, 121 aa, Artificial Sequence
  Description of Artificial Sequence: Synthetic polypeptide
QVQLVQSGAEVKKPGASVKVSCKASGYTFTSYNMHWVRQPPGKGLEWIGAIYPGNGDTSYNQKFKGRVTITADESTSTAYMELSSLRSEDTAVYYCARSTYYGGDWYFNVWGQGTTVTVSS

SEQ ID NO: 5570 - protein, 121 aa, Artificial Sequence
  Description of Artificial Sequence: Synthetic polypeptide
QVQLVQSGAEVKKPGASVKVSCKASGYTFTSYNMHWVRQAPGKGLEWIGAIYPGNGDTSYNQKFKGRVTITADKSTSTAYMELSSLRSEDTAVYYCARSTYYGGDWYFNVWGQGTTVTVSS

SEQ ID NO: 5571 - protein, 121 aa, Artificial Sequence
  Description of Artificial Sequence: Synthetic polypeptide
QVQLVQSGAEVKKPGASVKVSCKASGYTFTSYTMHWVRQAPGKGLEWIGAIYPGNSDTNYNQKFKGRVTITADKSTSTAYMELSSLRSEDTAVYYCARSTYYGGDWNFEVWGQGTTVTVSS

SEQ ID NO: 5572 - protein, 122 aa, Artificial Sequence
  Description of Artificial Sequence: Synthetic polypeptide
EVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSS

SEQ ID NO: 5573 - protein, 121 aa, Artificial Sequence
  Description of Artificial Sequence: Synthetic polypeptide
QVQLQQPGAELKKPGASVKVSCKASGYTFTSYNMHWVKQTPGRGLEWTGAIYPGNGDTSYNQKFKGKTTLTADKSSSTAYMELSSLRSEDTAVYYCARSTYYGGDWYFNVWGAGTTVTVSA

SEQ ID NO: 5574 - protein, 106 aa, Artificial Sequence
  Description of Artificial Sequence: Synthetic polypeptide
QIVLSQSPAIITASPGEKVTMTCRASTSVSYIHWFQQKPTSSPKPWIYATSNLASGVPSRFSGSGSGTTYSMTISSLEAEDAATYYCQQWTSNPPTFGGGTKLEIK

SEQ ID NO: 5575 - protein, 106 aa, Artificial Sequence
  Description of Artificial Sequence: Synthetic polypeptide
QIVLSQSPAIITASPGEKVTMTCRASSSVSYIHWFQQKPGSSPKPWIYATSNLASGVPSRFSGSGSGTTYSMTISSLEAEDAATYYCQQWTSNPPTFGGGTKLEIK

SEQ ID NO: 5576 - protein, 120 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARWYYSNSYWYFDVWGTGTTVTVS

SEQ ID NO: 5577 - protein, 452 aa, Artificial Sequence; identical to SEQ ID NO: 4850
  Description of Artificial Sequence: Synthetic polypeptide

SEQ ID NO: 5578 - protein, 452 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSYRYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNAALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5579 - protein, 451 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIE

SEQ ID NO: 5580 - protein, 122 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSYRYWYFDVWGQGTLVTVSS

SEQ ID NO: 5581 - protein, 451 aa, Artificial Sequence
  Description of Artificial Sequence: Synthetic polypeptide
EVQLVESGGGLVQPGGSLRLSCAASGYTFTSYNMHWVRQAPGKGLEWVGAIYPGNGATSYNQKFKGRFTISVDKSKNTLYLQMNSLRAEDTAVYYCARVVYYSYRYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNATYRVVSVLTVLHQDWLNGKEYKCKVSNAALPAPIAATISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 5582 - protein, 122 aa, Artificial Sequence [sequence omitted]

SEQ ID NO: 5583 - protein, 128 aa, Artificial Sequence; identical to SEQ ID NO: 5523
  Description of Artificial Sequence: Synthetic polypeptide

SEQ ID NO: 5584 - protein, 126 aa, Artificial Sequence; identical to SEQ ID NO: 5526
  Description of Artificial Sequence: Synthetic polypeptide

SEQ ID NO: 5585 - protein, 123 aa, Artificial Sequence; identical to SEQ ID NO: 5529
  Description of Artificial Sequence: Synthetic polypeptide

SEQ ID NO: 5586 - protein, 123 aa, Artificial Sequence; identical to SEQ ID NO: 5533
  Description of Artificial Sequence: Synthetic polypeptide

SEQ ID NO: 5587 - protein, 127 aa, Artificial Sequence; identical to SEQ ID NO: 5472
  Description of Artificial Sequence: Synthetic polypeptide

SEQ ID NO: 5588 - protein, 122 aa, Artificial Sequence; identical to SEQ ID NO: 5474
  Description of Artificial Sequence: Synthetic polypeptide

SEQ ID NO: 5589 - protein, 123 aa, Artificial Sequence; identical to SEQ ID NO: 5543
  Description of Artificial Sequence: Synthetic polypeptide

SEQ ID NO: 5590 - protein, 122 aa, Artificial Sequence; identical to SEQ ID NO: 5544
  Description of Artificial Sequence: Synthetic polypeptide

SEQ ID NO: 5591 - protein, 123 aa, Artificial Sequence; identical to SEQ ID NO: 5478
  Description of Artificial Sequence: Synthetic polypeptide

SEQ ID NO: 5592 - protein, 127 aa, Artificial Sequence; identical to SEQ ID NO: 5467
  Description of Artificial Sequence: Synthetic polypeptide

SEQ ID NO: 5593 - protein, 123 aa, Artificial Sequence; identical to SEQ ID NO: 5480
  Description of Artificial Sequence: Synthetic polypeptide

SEQ ID NO: 5594 - protein, 126 aa, Artificial Sequence; identical to SEQ ID NO: 5554
  Description of Artificial Sequence: Synthetic polypeptide

SEQ ID NO: 5595 - protein, 127 aa, Artificial Sequence; identical to SEQ ID NO: 5484
  Description of Artificial Sequence: Synthetic polypeptide

SEQ ID NO: 5596 - protein, 123 aa, Artificial Sequence; identical to SEQ ID NO: 5488
  Description of Artificial Sequence: Synthetic polypeptide

SEQ ID NO: 5597 - protein, 123 aa, Artificial Sequence; identical to SEQ ID NO: 5466
  Description of Artificial Sequence: Synthetic polypeptide

SEQ ID NO: 5598 - protein, 122 aa, Artificial Sequence; identical to SEQ ID NO: 5460
  Description of Artificial Sequence: Synthetic polypeptide

SEQ ID NO: 5599 - protein, 121 aa, Artificial Sequence
  Description of Artificial Sequence: Synthetic polypeptide
EVQLVQSGAEVKKPGESLKISCKGSGYSFTNYWIVWVRQMPGKGLEWMGIIYPGDSDTRYSPSFQGQVTISADKSISTAYLQWSSLKASDTAMYYCARHGDYYYYYGMDVWGQGTTVTVSS

SEQ ID NO: 5600 - protein, 121 aa, Artificial Sequence
  Description of Artificial Sequence: Synthetic polypeptide
EVQLVQSGAEVKKPGESLKISCKGSRNSFTNYWIGWVRQMPGKGLEWMGIIYPGDSDTRYSPSFQGQVTISADKSISTAYLQWSSLKASDTAMYYCARTGSYSYYYGMDVWGQGTTVTVSS

SEQ ID NO: 5601 - protein, 121 aa, Artificial Sequence
  Description of Artificial Sequence: Synthetic polypeptide
GVQLVQSGAEVKKPGESLKISCKGSGYSFTSYWIGWVRQMPGKGLEWMGIIYPGDSDTRYSPSFQGQVIISADKSISTAYLQWSSLKASDTAMYYCARTGDYYSYHGMDVWGQGTTVTVSS

SEQ ID NO: 5602 - protein, 124 aa, Artificial Sequence
  Description of Artificial Sequence: Synthetic polypeptide
EVQLVQSGAEVKKSGESLKISCKGSGYSFTNFWIGWVRQMPGKGLEWMGIIYPGDSDTRYSPSFQGQVTISADKSISTTYLQWSSLKASDTAMYYCARHPPYSGSYYADAFDIWGQGTMVTVSS

SEQ ID NO: 5603 - protein, 124 aa, Artificial Sequence
  Description of Artificial Sequence: Synthetic polypeptide
EVQLVQSGAEVKKPGESLKISCKGSGYSFTSFWIGWVRQMPGKGLEWMGIIYPGDSDTRYSPSFRGLVTISADKSISTAYLHWSSLKASDTAIFYCARHPPYSGSYYADAFDIWGQGTMVTVSS

SEQ ID NO: 5604 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARTGDYHNYYGMDVWGQGTTVTVSS

SEQ ID NO: 5605 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPADSDTRYSPSFQGQVTISADKSLNTAYLQWRSLKASDTAMYYCARIGDFYYYSGMDVWGQGTTVTVSS

SEQ ID NO: 5606 - protein, 121 aa, Artificial Sequence
  Description of Artificial Sequence: Synthetic polypeptide
EVQLVQSGAEVKKPGESLKISCKGSGYIFTSYWIAWVRQMPGKGLEWMGIIYPGDSDTRYSPSFQGQITISADKSISTAYLQWSSLKASDTAMYYCARVGTTNYYYGMDVWGQGTSVTVSS

SEQ ID NO: 5607 - protein, 121 aa, Artificial Sequence
  Description of Artificial Sequence: Synthetic polypeptide
EVQLVQSGAEVKKPGESLKISCKGSGYSFTTYWIGWVRQMPGKGLEWMGIIYPGDSDTRYSPSFQGQVTISADKSISTAYLQWSSLKASDTAMYYCARIGDYYSYSGLDVWGQGTTVTVSS

SEQ ID NO: 5608 - protein, 122 aa, Artificial Sequence
  Description of Artificial Sequence: Synthetic polypeptide
QVQLQQSGPGLMKPSQTLSLTCAISGDSVSSNSVSWNWIRQSPSRGLEWLGRTYYRFKWFNDYAVSVKSRITINPDTSKNQFSLRLNSVTPEDTALYYCARIDIWNDVFDYWGQGTLVTVSS

SEQ ID NO: 5609 - protein, 122 aa, Artificial Sequence
  Description of Artificial Sequence: Synthetic polypeptide
EVQLVQSGAEVKKPGESLKISCKGSGYSFTSYWIGWVRQMSGKGLEWMGIIYPGDSDTRYSPSFQGQVTISADKSISTAYLQWSSLKASDTAIYYCARHPSYGSGSPNFDYWGQGTLVTVSS

SEQ ID NO: 5610 - protein, 121 aa, Artificial Sequence
  Description of Artificial Sequence: Synthetic polypeptide
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARQGDYYHYSGMDVWGQGTTVTVSS

SEQ ID NO: 5611 - protein, 122 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYRPSFQGQVTISADKSITTAYLQWSSLKASDTAMYYCARHPSYGSGSPNFDYWGQGTLVTVSS

SEQ ID NO: 5612 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGDYYNYYGMDVWGQGTTVTVSS

SEQ ID NO: 5613 - protein, 122 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSITTAYLQWSSLKASDTAMYYCARHPSYGSGSPNFDYWGQGTLVTVSS

SEQ ID NO: 5614 - protein, 122 aa, Artificial Sequence; identical to SEQ ID NO: 5613
  Description of Artificial Sequence: Synthetic polypeptide

SEQ ID NO: 5615 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHGDYSNIDAFDIWGQGTMVTVSS

SEQ ID NO: 5616 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARTGTTDYYSGMDVWGQGTTVTVSS

SEQ ID NO: 5617 - protein, 122 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHGDFWSGYYSFDYWGQGTLVTVSS

SEQ ID NO: 5618 - protein, 122 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGDFWSGYGGMDVWGQGTTVTVSS

SEQ ID NO: 5619 - protein, 122 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTKYSPSFQGQVTISADKSISTAYLQWSSLKASDTAMYYCARQGDFWSGNGGMDVWGQGTTVTVSS

SEQ ID NO: 5620 - protein, 123 aa, Artificial Sequence
  Description of Artificial Sequence: Synthetic polypeptide
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHGDYYASESSAFDIWGQGTMVTVSS

SEQ ID NO: 5621 - protein, 121 aa, Artificial Sequence
  Description of Artificial Sequence: Synthetic polypeptide
EVQLVQSGAEVKKPGESLKISCKGSGYSFTSYWIDWVRQMPGKGLEWMGSIYPGDSDTRYSPSFQGQVTISADKSISTAYLQWSSLKASDTAMYYCARQGASGYYYGMDVWGQGTTVTVSS

SEQ ID NO: 5622 - protein, 124 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARMGDFWSGYYTRGMDVWGQGTTVTVSS

SEQ ID NO: 5623 - protein, 117 aa, Artificial Sequence
  Description of Artificial Sequence: Synthetic polypeptide
QVQLVQSGAEVKKPGASVKVSCTASGYSFSSYGISWVRQAPGQGLEWMGWISAYNGHTRYAQKLQGRVTMTSDTSTSTAYMELRSLRSDDTAVYYCARASSWYFDCWGQGTLVTVSS

SEQ ID NO: 5624 - protein, 117 aa, Artificial Sequence
  Description of Artificial Sequence: Synthetic polypeptide
QVQLVQSGAEVKKPGASVKVSCKASGYTFTSYGISWVRQAPGQGLEWMGWINAYNGNTNYAQKLRGRVTMTTDTFTSTADMELRSLRSDDTAVYYCARASTAMGDYWGQGTLVTVSS

SEQ ID NO: 5625 - protein, 123 aa, Artificial Sequence
  Description of Artificial Sequence: Synthetic polypeptide
EVQLVQSGAEVKKPGESLKISCKGSGYSFTNYWIAWVRQMPGKGLEWMGIIFPGDSDTRYSPAFQGQVTISADKSISTAYLHWSSLKASDTAMYYCARHRDYTSGGPDAFDVWGQGTMVTVSS

SEQ ID NO: 5626 - protein, 121 aa, Artificial Sequence
  Description of Artificial Sequence: Synthetic polypeptide
EVQLVQSGAEVKKPGESLKISCKGSGYSFTSYWIAWVRQMPGKGLEWMGIIYPGDSDTRYSPSFQGQVTISADKSISTAYLQWSNLKASDTAMYYCARTGSYYNYCGMDVWGQGTTVTVSS

SEQ ID NO: 5627 - protein, 121 aa, Artificial Sequence
  Description of Artificial Sequence: Synthetic polypeptide
EVQLVQSGAEVKKPGESLKISCKGSGYSFTNYWIAWVRQMPGKGLEWMGIIYPGDSDTRYSPSFQGQVTISADKSISTAYLQWSSLKASDTAMYYCTRQGDYYDSSGPDYWGQGTLVTVSS

SEQ ID NO: 5628 - protein, 115 aa, Artificial Sequence
  Description of Artificial Sequence: Synthetic polypeptide
QVQLVESAGGVVQPGRSLRLSCAASGFTFSSYGMHWVRQAPGKGLEWVAVIWHDGSKKYYEDSVKGRFTISRDNSKNTLYLQMNSLRAEDTAVYYCARNWFFDYWGQGTLVTVSS

SEQ ID NO: 5629 - protein, 122 aa, Artificial Sequence
  Description of Artificial Sequence: Synthetic polypeptide
QVQLVESGGGLVKPGGSLRLSCAASGFTFSDYYMSWIRQAPGKGLEWVSYISSSGTTIYYADSVKGRFTISRDNAKNSLYLQMNSLRAEDTAVYYCARDLYYGGNSYYFDYWGQGTLVTVSS

SEQ ID NO: 5630 - protein, 121 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSIRTAYLQWSSLKASDTAMYYCARIGDHYHYNGMDVWGQGTTVTVSS

SEQ ID NO: 5631 - protein, 121 aa, Artificial Sequence
  Description of Artificial Sequence: Synthetic polypeptide
EVQLVQSGAEVKKPGESLKISCKGSGYSFSSYWINWVRQMPGKGLEWMGIIYPGDSDTRYSPSFQGQVTISADKSISTAYLQWRSLKASDTAIYYCARVGDYYSYYGMDVWGQGTTVTVSS

SEQ ID NO: 5632 - protein, 121 aa, Artificial Sequence
  Description of Artificial Sequence: Synthetic polypeptide
EVQLVQSGAEVKKPGESLKISCKGSGYSFTNYWINWVRQMPGKGLEWMGIIYPGDSDTRYSPSFQGQVTISADKSINTAYLQWSSLKASDTAMYYCARQGGHYYYSGMDVWGQGTTVTVSS

SEQ ID NO: 5633 - protein, 140 aa, Artificial Sequence; identical to SEQ ID NO: 5268
  Description of Artificial Sequence: Synthetic polypeptide

SEQ ID NO: 5634 - protein, 117 aa, Artificial Sequence
  Description of Artificial Sequence: Synthetic polypeptide
EVQLQESGPGLVAPSQSLSITCTVSGFSLSDYGVNWVRQIPGKGLEWLGIIWGDGRTDYNSALKSRLNISKDNSKSQVFLKMNSLKADDTARYYCARAPGNRAMEYWGQGTSVTVSS

SEQ ID NO: 5635 - protein, 121 aa, Artificial Sequence
  Description of Artificial Sequence: Synthetic polypeptide
EVQLQESGGGLVQPGGSLRLSCATSGFTFIDYYMNWVRQPPGKALEWLGFIKNKFNGYTTEYNTSVKGRFTISRDNSQSILYLQMNTLRAEDSATYYCARGLGRSYAMDYWGQGTSVTVSS

SEQ ID NO: 5636 - protein, 119 aa, Artificial Sequence
  Description of Artificial Sequence: Synthetic polypeptide
EVQLQESGGGLGATWRSMKLSCVASGFTFSYYWMNWVRQSPEKGLEWIAEIRLKSNNYATHYAESVKGRFTISRDDSKSSVYLQMNNLRAEDTGIYYCTRYDGSSRDYWGQGTTLTVSS

SEQ ID NO: 5637 - protein, 118 aa, Artificial Sequence
  Description of Artificial Sequence: Synthetic polypeptide
EVQLQESGPGLVKPSQSLSLTCSVTGYSITSGYYWNWIRQFPGNKLEWMGYIRYDGSNNYNPSLKNRISITRDTSKNQFFLKLNSVTTEDTATYYCARGGITVAMDYWGQGTSVTVSS

SEQ ID NO: 5638 - protein, 122 aa, Artificial Sequence
  Description of Artificial Sequence: Synthetic polypeptide
EVQLQESGPDLVKPGASVKISCKASGYSFIGYYMHWLKQSHGKSLEWIGAVNPNTAGLTYNQRFKDKAILTVDKSSNTAYMELRSLTSEDSAVYYCSRVDYDDYGYWFFDVWGAGTTVTVSS

SEQ ID NO: 5639 - protein, 135 aa, Artificial Sequence
  Description of Artificial Sequence: Synthetic polypeptide
MESQTQVFVFLLLCVSGAHGSIVMTQTPKFLLVSTGDRVTITCKASQTVTNDLAWYQQKPGQSPKLLIYYASNRYTGVPDRFTGSGYGTDFTFTINTVQAEDLAVYFCQQDYSSPLTFGAGTKLELKRADAAPTV

SEQ ID NO: 5640 - protein, 135 aa, Artificial Sequence
  Description of Artificial Sequence: Synthetic polypeptide
MESQTQVFVFLLLCVSGAHGSIVMTQTPKFLLVSAGDRVSITCKASQSVTNDVTWYQQKPGQSPKLLIYFASNRYTGVPDRFTGSGYGTDFTFTISTVQAEDLAVYFCQQDYSSPLTFGAGTKLELKRADAAPTV

SEQ ID NO: 5641 - protein, 139 aa, Artificial Sequence
  Description of Artificial Sequence: Synthetic polypeptide
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIKRADAAPTV

SEQ ID NO: 5642 - protein, 119 aa, Artificial Sequence
  Description of Artificial Sequence: Synthetic polypeptide
EVQLQESGPELVKPGASMKISCKASGYSFTDYTMNWVKQSHGKNLEWIGLLHPFNGGTSYNQKFKGKATLSVDKSSSTAFMELLSLTSEDSAVYFCARGTGRNYAMDYWGQGTSVTVSS

SEQ ID NO: 5643 - protein, 120 aa, Artificial Sequence
  Description of Artificial Sequence: Synthetic polypeptide
QVQLQESGPGLVKPSETLSLTCTVSGGSISSFYWSWIRQSPGKGLEWIGYIYYTGSTNYNPSLKSRVTISVDMSKNQFSLKLISLTAADTAVYYCARDSGSAWPRNFDYWGQGTLVTVSS

SEQ ID NO: 5644 - protein, 117 aa, Artificial Sequence
  Description of Artificial Sequence: Synthetic polypeptide
QVTLKESGPALVKPTQTLTLTCTFSGFSLSDYGVNWIRQPPGKALEWLAIIWGDGRTDYNSALKSRLTISKDTSKNQVVLTMTNVDPMDTATYYCARAPGNRAMEYWGQGTLVTVSS

SEQ ID NO: 5645 - protein, 117 aa, Artificial Sequence
  Description of Artificial Sequence: Synthetic polypeptide
QVQLQESGPALVKPTQTLTLTCTFSGFSLSDYGVNWIRQPPGKALEWLAIIWGDGRTDYNSALKSRLSISKDTSKNQVVLRMTNVDPVDTATYFCARAPGNRAMEYWGQGTVVTVSS

SEQ ID NO: 5646 - protein, 136 aa, Artificial Sequence
  Description of Artificial Sequence: Synthetic polypeptide
MDTLCSTLLLLTIPSWVLSQVQLQESGPALVKPTQTLTLTCTFSGFSLSDYGVNWIRQPPGKALEWLAIIWGDGRTDYNSALKSRLSISKDTSKNQVVLRMTNVDPVDTATYFCARAPGNRAMEYWGQGTVVTVSS

SEQ ID NO: 5647 - protein, 136 aa, Artificial Sequence
  Description of Artificial Sequence: Synthetic polypeptide
MDTLCSTLLLLTIPSWVLSQVQLQESGPALVKPTQTLTLTCTFSGFSLSDYGVNWIRQPPGKALEWLGIIWGDGRTDYNSALKSRLSISKDNSKNQVVLRMTNVDPVDTATYFCARAPGNRAMEYWGQGTVVTVSS

SEQ ID NO: 5648 - protein, 147 aa, Artificial Sequence
  Description of Artificial Sequence: Synthetic polypeptide
KLAATMAVLALLFCLVTFPSCILSQVQLKESGPGLVAPSQSLSITCTVSGFSLSDYGVNWVRQIPGKGLEWLGIIWGDGRTDYNSALKSRLNISKDNSKSQVFLKMNSLKADDTARYYCARAPGNRAMEYWGQGTSVTVSSASTKGP

SEQ ID NO: 5649 - protein, 136 aa, Artificial Sequence
  Description of Artificial Sequence: Synthetic polypeptide
MDTLCSTLLLLTIPSWVLSQVQLQESGPALVKPTQTLTLTCTFSGFSLSDYGVNWIRQPPGKALEWLGIIWGDGRTDYNSALKSRLSISKDTSKNQVVLRMTNVDPVDTATYFCARAPGNRAMEYWGQGTVVTVSS

SEQ ID NO: 5650 - protein, 136 aa, Artificial Sequence
  Description of Artificial Sequence: Synthetic polypeptide
MDTLCSTLLLLTIPSWVLSQVQLQESGPALVKPTQTLTLTCTFSGFSLSDYGVNWIRQPPGKALEWLAIIWGDGRTDYNSALKSRLSISKDNSKNQVVLRMTNVDPVDTATYFCARAPGNRAMEYWGQGTVVTVSS

SEQ ID NO: 5651 - protein, 136 aa, Artificial Sequence
  Description of Artificial Sequence: Synthetic polypeptide
MDTLCSTLLLLTIPSWVLSQVQLQESGPALVKPTQTLTLTCTVSGFSLSDYGVNWIRQPPGKALEWLGIIWGDGRTDYNSALKSRLSISKDNSKNQVVLRMTNVDPVDTATYFCARAPGNRAMEYWGQGTVVTVSS

SEQ ID NO: 5652 - protein, 126 aa, Artificial Sequence
  Description of Artificial Sequence: Synthetic polypeptide
QVQLQESGPALVKPTQTLILTCTFSGFSLSTRGMSVNWIRQPPGKALEWLARIDWDDDTFYSASLKTRLSISKDTSKNQVVLRMTNVDPVDTATYFCARASLYDSDSFYLFYHAYWGQGTVVTVSS

SEQ ID NO: 5653 - protein, 116 aa, Artificial Sequence
  Description of Artificial Sequence: Synthetic polypeptide
QVQLKESGPGLVAPSQSLSITCTVSGFSLSDYGVNWVRQIPGKGLEWLGIIWGDGRTDYNSALKSRLNISKDNSKSQVFLKMNSLKADDTARYYCARAPGNRAMEYWGQGTSVTVS

SEQ ID NO: 5654 - protein, 96 aa, Artificial Sequence
  Description of Artificial Sequence: Synthetic polypeptide
QVTLKESGPALVKPTQTLTLTCTFSGFSLSTSGMRVSWIRQPPGKALEWLARIDWDDDKFYSTSLKTRLTISKDTSKNQVVLTMTNVDPMDTATYY

SEQ ID NO: 5655 - protein, 121 aa, Artificial Sequence; identical to SEQ ID NO: 4904
  Description of Artificial Sequence: Synthetic polypeptide

SEQ ID NO: 5656 - protein, 121 aa, Artificial Sequence
  Description of Artificial Sequence: Synthetic polypeptide
EVQLVQSGAEVKKPGASVKVSCKASGYRFTNYWIHWVRQAPGQGLEWIGGINPGNQYTTYKRNLKGRATLTADTSTSTVYMELSSLRSEDTAVYYCTREGYGNYGAWFAYWGQGTLVTVSS

SEQ ID NO: 5657 - protein, 121 aa, Artificial Sequence
  Description of Artificial Sequence: Synthetic polypeptide
EVQLQQSGTVLARPGASVKMSCKASGYRFTNYWIHWVKQRPGQGLEWIGGINPGNNYTTYKRNLKGKATLTAVTSASTAYMDLSSLTSEDSAVYYCTREGYGNYGAWFAYWGQGTLVTVSS

SEQ ID NO: 5658 - protein, 121 aa, Artificial Sequence
  Description of Artificial Sequence: Synthetic polypeptide
QVQLVQSGAEVKKPGASVKVSCKASGYTFTRSTMHWVRQAPGQGLEWIGYINPSSAYTNYNQKFKDRVTITADKSTSTAYMELSSLRSEDTAVYYCASPQVHYDYNGFPYWGQGTLVTVSS

SEQ ID NO: 5659 - protein, 121 aa, Artificial Sequence
  Description of Artificial Sequence: Synthetic polypeptide
QVQLQQSGAELARPGASVKMSCKASGYTFTRSTMHWVKQRPGQGLEWIGYINPSSAYTNYNQKFKDKATLTADKSSSTAYMQLSSLTSEDSAVYYCASPQVHYDYNGFPYWGQGTLVTVSS

SEQ ID NO: 5660 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCARHGNFGNSYVSWFAYWGQGTLVTVSS

SEQ ID NO: 5661 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCARHGNFGNSYVSWFAYWGQGTLVTVSS

SEQ ID NO: 5662 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVARIRSKYNNYATYYADSVKDRFTISRDDSKNSLYLQMNSLKTEDTAVYYCARHGNFGNSYVSWFAYWGQGTLVTVSS

SEQ ID NO: 5663 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 5664 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCARHGNFGNSYVSWFAYWGQGTLVTVSS

SEQ ID NO: 5665 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKDRFTISRDDSKNSLYLQMNSLKTEDTAVYYCVRHGNFGNSYVSWFAYWGQGTLVTVSS

SEQ ID NO: 5666 - protein, 125 aa, Artificial Sequence
  Description of Artificial Sequence: Synthetic polypeptide
EVQLVESGGGLVQPGGSLRLSCAASGFTFSTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSS

SEQ ID NO: 5667 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRSKYNNYATYYADSVKDRFTISRDDSKNSLYLQMNSLKTEDTAVYYCVRHGNFGNSYVSWFAYWGQGTLVTVSS

SEQ ID NO: 5668 - protein, 125 aa, Artificial Sequence
  Description of Artificial Sequence: Synthetic polypeptide
EVQLVESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 5669 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRNKYNNYATEYADSVKDRFTISRDDSKNSLYLQMNSLKTEDTAVYYCVRHGNFGNSYVSWFAYWGQGTLVTVSS

SEQ ID NO: 5670 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRNKYNNYATEYADSVKDRFTISRDDSKNSLYLQMNSLKTEDTAVYYCVRHGNFGNSYVSWFAYWGQGTLVTVSS

SEQ ID NO: 5671 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARTRSKANSYTTYYAASVKGRFTISRDDSKNSLYLQMNSLKTEDTAVYYCARHGNFGNSYVSWFAYWGQGTLVTVSS

SEQ ID NO: 5672 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRTRSKANSYTTYYAASVKGRFTISRDDSKNSLYLQMNSLKTEDTAVYYCARHGNFGNSYVSWFAYWGQGTLVTVSS

SEQ ID NO: 5673 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSA

SEQ ID NO: 5674 - protein, 271 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGQVQLQQSGPELVKPGASVKISCKASGYTFSGSWMNWVKQRPGQGLEWIGRIYPGDGETNYNGKFKDKATLTADKSSTTAYMELSSLTSVDSAVYFCARIYGNNVYFDVWGAGTTVTVSSGGCGGGEVAALEKEVAALEKEVAALEKEVAALEK

SEQ ID NO: 5675 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVARIRNKYNNYATEYAASVKDRFTISRDDSKNSLYLQMNSLKTEDTAVYYCVRHGNFGNSYVSWFAYWGQGTLVTVSS

SEQ ID NO: 5676 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTASKANNYATYYADSVKDRFTISRDDSQSILYLQMNNLKTEDTAMYYCVRHGNFGNSYVSWFAYWGQGTLVTVSA

SEQ ID NO: 5677 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKYNSYATYYADSVKDRFTISRDDSQSILYLQMNNLKTEDTAMYYCVRHGNFGNSYVSWFAYWGQGTLVTVSA

SEQ ID NO: 5678 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKYNNYTTYYADSVKDRFTISRDDSQSILYLQMNNLKTEDTAMYYCVRHGNFGNSYVSWFAYWGQGTLVTVSA

SEQ ID NO: 5679 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKANSYATYYADSVKDRFTISRDDSQSILYLQMNNLKTEDTAMYYCVRHGNFGNSYVSWFAYWGQGTLVTVSA

SEQ ID NO: 5680 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKYNSYTTYYADSVKDRFTISRDDSQSILYLQMNNLKTEDTAMYYCVRHGNFGNSYVSWFAYWGQGTLVTVSA

SEQ ID NO: 5681 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKANSYTTYYADSVKDRFTISRDDSQSILYLQMNNLKTEDTAMYYCVRHGNFGNSYVSWFAYWGQGTLVTVSA

SEQ ID NO: 5682 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKYNNYATYYAASVKDRFTISRDDSQSILYLQMNNLKTEDTAMYYCVRHGNFGNSYVSWFAYWGQGTLVTVSA

SEQ ID NO: 5683 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKYNNYATYYADSVKGRFTISRDDSQSILYLQMNNLKTEDTAMYYCVRHGNFGNSYVSWFAYWGQGTLVTVSA

SEQ ID NO: 5684 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKANSYATYYAASVKDRFTISRDDSQSILYLQMNNLKTEDTAMYYCVRHGNFGNSYVSWFAYWGQGTLVTVSA

SEQ ID NO: 5685 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKANSYATYYADSVKGRFTISRDDSQSILYLQMNNLKTEDTAMYYCVRHGNFGNSYVSWFAYWGQGTLVTVSA

SEQ ID NO: 5686 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARTRSKANSYATYYAASVKGRFTISRDDSQSILYLQMNNLKTEDTAMYYCVRHGNFGNSYVSWFAYWGQGTLVTVSA

SEQ ID NO: 5687 - protein, 125 aa, Artificial Sequence; identical to SEQ ID NO: 5672
  Description of Artificial Sequence: Synthetic polypeptide

SEQ ID NO: 5688 - protein, 125 aa, Artificial Sequence; identical to SEQ ID NO: 5671
  Description of Artificial Sequence: Synthetic polypeptide

SEQ ID NO: 5689 - protein, 123 aa, Artificial Sequence
  Description of Artificial Sequence: Synthetic polypeptide
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 5690 - protein, 127 aa, Artificial Sequence; identical to SEQ ID NO: 5467
  Description of Artificial Sequence: Synthetic polypeptide

SEQ ID NO: 5691 - protein, 112 aa, Artificial Sequence
  Description of Artificial Sequence: Synthetic polypeptide
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSS

SEQ ID NO: 5692 - protein, 116 aa, Artificial Sequence
  Description of Artificial Sequence: Synthetic polypeptide
EVQLVESGGGLVQPGGSLRLSCVASGFTFSNSWMSWVRQAPGKGLEWVANINEDGSEKFYVDSVKGRFTFSRDNAENSLYLQMNSLRAEDTAVYYCARVHWYFHLWGRGTLVTVSS

SEQ ID NO: 5693 - protein, 116 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTKYTPSLKSRVTISVDTSKHQFSLKLSSVTAADTAVYYCARETVYYFDLWGRGTLVTVSS

SEQ ID NO: 5694 - protein, 112 aa, Artificial Sequence; identical to SEQ ID NO: 5691
  Description of Artificial Sequence: Synthetic polypeptide

SEQ ID NO: 5695 - protein, 116 aa, Artificial Sequence; identical to SEQ ID NO: 5692
  Description of Artificial Sequence: Synthetic polypeptide

SEQ ID NO: 5696 - protein, 97 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCAR

SEQ ID NO: 5697 - protein, 98 aa, Artificial Sequence
  Description of Artificial Sequence: Synthetic polypeptide
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAR

SEQ ID NO: 5698 - protein, 116 aa, Artificial Sequence; identical to SEQ ID NO: 5693
  Description of Artificial Sequence: Synthetic polypeptide

SEQ ID NO: 5699 - protein, 117 aa, Artificial Sequence
  Description of Artificial Sequence: Synthetic polypeptide
QVQLVQSGAEVKKPGASVKVSCKVSGYTFTDYYITWVRQAPGQALEWMGWIYPGSGNTKYSQKFQGRFVFSVDTSASTAYLQISSLKAEDTAVYYCANYGNYWFAYWGQGTLVTVSS

SEQ ID NO: 5700 - protein, 117 aa, Artificial Sequence; identical to SEQ ID NO: 5378
  Description of Artificial Sequence: Synthetic polypeptide

SEQ ID NO: 5701 - protein, 117 aa, Artificial Sequence; identical to SEQ ID NO: 5380
  Description of Artificial Sequence: Synthetic polypeptide

SEQ ID NO: 5702 - protein, 117 aa, Artificial Sequence
  Description of Artificial Sequence: Synthetic polypeptide
QLQLVQSGPEVKKPGASVKVSCKVSGYTFTDYYITWVRQAPGQALEWMGWIYPGSGNTKYNEKFQGRFVFSVDTSASTAYLQISSLKAEDTAVYFCANYGNYWFAYWGQGTLVTVSS

SEQ ID NO: 5703 - protein, 117 aa, Artificial Sequence
  Description of Artificial Sequence: Synthetic polypeptide
QLQLVQSGAEVKKPGASVKVSCKVSGYTFTDYYITWVRQAPGQALEWMGWIYPGSGNTKYSQKFQGRFVFSVDTSASTAYLQISSLKAEDTAVYYCANYGNYWFAYWGQGTLVTVSS

SEQ ID NO: 5704 - protein, 117 aa, Artificial Sequence
  Description of Artificial Sequence: Synthetic polypeptide
QLQLVQSGAEVKKPGASVKVSCKVSGYTFTSYYISWVRQAPGQALEWMGWIYAGSGNTKYSQKFQGRFVFSVDTSASTAYLQISSLKAEDTAVYYCANYGNYWFAYWGQGTLVTVSS

SEQ ID NO: 5705 - protein, 112 aa, Artificial Sequence; identical to SEQ ID NO: 5691
  Description of Artificial Sequence: Synthetic polypeptide

SEQ ID NO: 5706 - protein, 116 aa, Artificial Sequence; identical to SEQ ID NO: 5692
  Description of Artificial Sequence: Synthetic polypeptide

SEQ ID NO: 5707 - protein, 116 aa, Artificial Sequence; identical to SEQ ID NO: 5693
  Description of Artificial Sequence: Synthetic polypeptide

SEQ ID NO: 5708 - protein, 97 aa, Artificial Sequence; identical to SEQ ID NO: 5696
  Description of Artificial Sequence: Synthetic polypeptide

SEQ ID NO: 5709 - protein, 98 aa, Artificial Sequence; identical to SEQ ID NO: 5697
  Description of Artificial Sequence: Synthetic polypeptide

SEQ ID NO: 5710 - protein, 116 aa, Artificial Sequence
  Description of Artificial Sequence: Synthetic polypeptide
DVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSA

SEQ ID NO: 5711 - protein, 123 aa, Artificial Sequence
  Description of Artificial Sequence: Synthetic polypeptide
QVQLKESGPGLVAPSQSLSITCTVSGFSLSRYSVQWVRQPPGKGLEWLGMIWGGGSTDYNSGLKSRLTISKDNSKSQVFLKMNSLQTDDTAMYFCARTQFYYGHDGGYAMDFWGQGTSVTVSS

SEQ ID NO: 5712 - protein, 120 aa, Artificial Sequence
  Description of Artificial Sequence: Synthetic polypeptide
DVQLVESGGGLVQPGGSRKLSCAASGFTFSSYGMHWVRQAPETGLEWVAYITTRSSTIYYAATVKGRFTISRDNARNTLFLQMTSLRSEDTAMYYCTREPLTGYYAMDYWGQGTSVTVSS

SEQ ID NO: 5713 - protein, 123 aa, Artificial Sequence
  Description of Artificial Sequence: Synthetic polypeptide
QVQLKESGPGLVAPSQSLSITCTVSGFSLSRYSVHWVRQPPGKGLEWLGMIWGGGSIDYNSGLKSRLSISKDNSKSQVFLKMNSLQSDDTAMYHCVRAQFYYGYDGGYAMDYWGQGTSVTVSS

SEQ ID NO: 5714 - protein, 118 aa, Artificial Sequence
  Description of Artificial Sequence: Synthetic polypeptide
SDVQLQESGPGLVKPSQSLSLTCTVTDYSITSDYAWNWIRQFPGNNLEWMGNIGYSGDTSYNPSLKSRISITRDTSKNQFFLQLNSVTTEDSATYYCARSSLGPFDYWGQGTALTVSS

SEQ ID NO: 5715 - protein, 118 aa, Artificial Sequence
  Description of Artificial Sequence: Synthetic polypeptide
QVQLQQSGNELVRPGSAVKISCKASGYAFSSYWMNWVKQRPGQGLEWIGQIYPGDDDSNYNGKFKGKATLTADKSSSSAYMHLSSLTSEDSAVYFCARGFATPTMDYWGQGTSVTVSS

SEQ ID NO: 5716 - protein, 119 aa, Artificial Sequence
  Description of Artificial Sequence: Synthetic polypeptide
QVQLQQSGAELMKTGASVKISCKATGYTFSSYWIEWVKQRPGHGLEWIGEILPGSGKTNYNENFKGKATFTADTSSNTAYMQLSSLTSEDSVVYYCARRGAYYGNFDYWGQGTTLTVSS

SEQ ID NO: 5717 - protein, 123 aa, Artificial Sequence
  Description of Artificial Sequence: Synthetic polypeptide
QVQLKESGPGLVAPSQSLSITCTVTGFSLSRYSVHWIRQPPGKGLEWLGMIWGGGSTDYNSALKSRLSINKDNSKSQVFLKMNSLQTVDTAMYYCARTQFYYGHDGGYAMDYWGQGTSVTVSS

SEQ ID NO: 5718 - protein, 116 aa, Artificial Sequence
  Description of Artificial Sequence: Synthetic polypeptide
EVQLQQSGPELLKPGASVKISCKASGYTFTDYNMHWVKQSHGKSLEWIGNIYPYNGGTGYNQKFKTKATLTVDNSSSTAYMELRSLTSEDSAVYYCAIGNYWFAFWGQGTLVTVSA

SEQ ID NO: 5719 - protein, 120 aa, Artificial Sequence
  Description of Artificial Sequence: Synthetic polypeptide
EVQLQQSGPDLVKPGTSVKISCKASGYSFTACYIHWVKQSHGKSLEWIGRFSPNNDRTTYNQKFKDKAILTVDKSSSTAYMDLRSLTSEDSAVYYCARGEESWDAWFTYWGQGTLVTVSA

SEQ ID NO: 5720 - protein, 119 aa, Artificial Sequence
  Description of Artificial Sequence: Synthetic polypeptide
QVTLKESGPGILQPSQTLSLTCSFSGFSLSTSGMGVGWIRQPSGKGLEWLAHIWWDDVKRYNPALKSRLTISKDTSSSQVFLKIASVDTADTATYHCARIAIGQPFAYWGQGTLVTVSA

SEQ ID NO: 5721 - protein, 120 aa, Artificial Sequence
  Description of Artificial Sequence: Synthetic polypeptide
QVQLQQPGAELVKPGASVKLSCRTSGYSFTSYWIHWVKQRPGRGLEWIGRIVPNSGGTKYNENFKNKATLTVDKSSNTAYMQLSSLTSEDSAVYYCTREDSYGPFDLDYWGQGTSVTVSS

SEQ ID NO: 5722 - protein, 121 aa, Artificial Sequence
  Description of Artificial Sequence: Synthetic polypeptide
EVQLQQSGPELVKPGASVKISCKASGYSFTGYFMNWVKQSHGKSLEWIGRINPYNGDNFYNQKFKGKATLTVDKSSSTAHMELLSLTSEDSAVYYCGRDYGSSYGWFFDVWGAGTTVTVSS

SEQ ID NO: 5723 - protein, 123 aa, Artificial Sequence
  Description of Artificial Sequence: Synthetic polypeptide
EVQLQQSGPELVKPGASMKISCKASGYTFTDHTMHWVKQSHGKNLEWIGRINPYNGDTSHNQNFKGKATLTVDKSSNTAYMELLSLTSEDSAVYYCARYGGDYTSSYYTMDYWGQGTSSTVSS

SEQ ID NO: 5724 - protein, 123 aa, Artificial Sequence
  Description of Artificial Sequence: Synthetic polypeptide
EVQLQQSGPELVKPGASMKISCKASGYTFTDYTMHWVRQSHGKNLEWIGRINPYNADTSHNQNFKGRATLTVDKSFNTAYMELLSLTSEDSAVYYCARYGGDFTSSYYTMDYWGQGTSVTVSS

SEQ ID NO: 5725 - protein, 118 aa, Artificial Sequence
  Description of Artificial Sequence: Synthetic polypeptide
QVQLKESGPGLVAPSQSLSITCTVSGFSLTSYTISWVRQPPGKGLEWLGIIWTAGATNYNSALKSRLSISKDNSKSQVFLKMNSLQTDDTARYYCARYSKDYYAVDYWGQGTSVTVSS

SEQ ID NO: 5726 - protein, 123 aa, Artificial Sequence
  Description of Artificial Sequence: Synthetic polypeptide
EVQLQQSGPELVKPGASMKISCKASGYTFTDYTMHWVKQSHGKNLEWIGRINPYNDDISHNQNFKDKATLTVDKSSNTAYMELLSLTSEDSAVYYCARYGGDYTSSYYTMDYWGQGTSVTVSS

SEQ ID NO: 5727 - protein, 123 aa, Artificial Sequence
  Description of Artificial Sequence: Synthetic polypeptide
QVQLKESGPGLVAPSQSLSITCTVSGFSLSRYSVHWVRQPSGKGLEWLGMIWGGGSTDYNSALKSRLIISKDNSKSQVFLKMNSLQTDDTAMYYCARTQFYYGHDGGYAMDYWGQGTSVTVSS

SEQ ID NO: 5728 - protein, 119 aa, Artificial Sequence
  Description of Artificial Sequence: Synthetic polypeptide
QVTLKESGPGILQPSQTLSLTCSFSGFSLSTSGMGVGWIRQPSGKGLEWLAHIWWDDVKRYNPALKSRLNISKDTSSSQVFLKIASVDTADTATYYCGRKSNSGYFDYWGQGTTLTVSS

SEQ ID NO: 5729 - protein, 116 aa, Artificial Sequence
  Description of Artificial Sequence: Synthetic polypeptide
EVQLQQSGPDLVKPGASVKISCKASGYSFTGYFMNWVKQSHGKSLEWIGRINPYNGDTFYNQKFKGKATLTVDKSSSTAHMELLSLTSEDSAVYYCGRGNYYFDYWGQGTTLTVSS

SEQ ID NO: 5730 - protein, 114 aa, Artificial Sequence
  Description of Artificial Sequence: Synthetic polypeptide
QVQLEQSGGDLVKPGGSLKLSCAASGFTFSSYGMSWVRQTPDKRLEWVATISSGGSYSYYPDSVKGRFTISRDNAKNTLYLQMSSLKSEDTAMYFCRPSFFPSWGQGTLVTVSA

SEQ ID NO: 5731 - protein, 109 aa, Artificial Sequence
  Description of Artificial Sequence: Synthetic polypeptide
EVQLQQSGAELVRPGASVKLSCTASGFNINDDYFHWVKQRPEQGLEWIGRIDPANGNTKYGPKFQDKATITADTSSNTAYLQFTSLTSEDTAVYYCASGWAFACWGQGT

SEQ ID NO: 5732 - protein, 123 aa, Artificial Sequence
  Description of Artificial Sequence: Synthetic polypeptide
EVQLQQSGPELVKPGTSMKISCKASGYTFTDYTMHWVKQSHGKNLEWIGRINPYTGSTSHNQNFKDKASLTVDKSSNTAYMDLLSLTSEDSAVYYCARFGGDYTSSYYTLDYWGQGTSVSVSS

SEQ ID NO: 5733 - protein, 117 aa, Artificial Sequence
  Description of Artificial Sequence: Synthetic polypeptide
EVQLQQSGPELVKPGDSVKMSCKASGNTVTNYYMDWVKQSHGKSLEWIGYIYANNGGTSYNQKFKGKATLTVDKSSSTAYMEIHSLTSEDSAVYYCAIYYRYEFAYWGQGTLVTVSA

SEQ ID NO: 5734 - protein, 121 aa, Artificial Sequence
  Description of Artificial Sequence: Synthetic polypeptide
SDVQLQESGPGLVKPSQSLSVTCTVTDYSLTSGYYWNWIRQFPGNKLEWMAYIHSSGSTHYNPSLKSRISVTRDTSKNQFFLQLNSVTTEDTATYYCARDGAYYSSWFPYWGQGTLVTVSA

SEQ ID NO: 5735 - protein, 112 aa, Artificial Sequence
  Description of Artificial Sequence: Synthetic polypeptide
QILLVQSGPELKKPGETVKISCKANYTFTDYGMHWVKQAPGKGLKWMGWINPKTGVASYADDFKGRFAFSLETSASTAYLQINNLENEDTSIYFCARFFDYWGQGTTLTVSS

SEQ ID NO: 5736 - protein, 118 aa, Artificial Sequence
  Description of Artificial Sequence: Synthetic polypeptide
QVQLVESGGGVVQPGRSLRLSCAASGFTFSSYGIHWVRQAPGKGLEWVAVIGYDGSDKNYADSVKGRFTIFRDNSKNTLYLQMNSLRAEDTAVYYCARDQLGDAFDIWGQGTMVTVSS

SEQ ID NO: 5737 - protein, 118 aa, Artificial Sequence
  Description of Artificial Sequence: Synthetic polypeptide
QVQLVQSGAEVKKPGASVKVSCKASGYTFTSYGLSWVRQAPGQGLEWMGWISPYNGNTHYAQKLQGRVTMTTDTSTSTADMDLRSLRSDDTAVYYCARASAAHGMDVWGQGTTVTVSS

SEQ ID NO: 5738 - protein, 118 aa, Artificial Sequence
  Description of Artificial Sequence: Synthetic polypeptide
QVQLVQSGAEVKKPGASVKVSCKASGYTFTSYGLSWVRQAPGQGLEWMGWISPYNGNTHYAQKLQGRVTMTTDTSTSTAYMDLRSLRSDDTAVYYCARDSAAHGMDVWGQGTTVTVSS

SEQ ID NO: 5739 - protein, 118 aa, Artificial Sequence
  Description of Artificial Sequence: Synthetic polypeptide
QVQLVQSGAEVKKPGASVKVSCKASGYTFTSYGLSWVRQAPGQGLEWMGWISAYNGNTNYAQKLQGRVTMTTDTSTSTAYMDLRSLRSDDTAVYYCARDSAAHGMDVWGQGTTVTVSS

SEQ ID NO: 5740 - protein, 118 aa, Artificial Sequence
  Description of Artificial Sequence: Synthetic polypeptide
QVQVVQSGAEVKKPGASVKVSCKTSGYTFTSYGISWVRQAPGQGLEWMGWISAYNGNTKYAQKLQGRLTMTTDTSTTTAYMELRSLRSDDTAVYYCARDSAAHGMDVWGQGTTVSVSS

SEQ ID NO: 5741 - protein, 117 aa, Artificial Sequence
  Description of Artificial Sequence: Synthetic polypeptide
EVQLLESGGGLVQPGGSLRLSCAASGFTFSNFVMSWVRQAPGKGLEWVSGISGSGGNTDHADSVKGRFTISRDNSKNTVYLQMNSLRAEDTAVYYCAKDSGGLFDYWGLGTLVTVSS

SEQ ID NO: 5742 - protein, 119 aa, Artificial Sequence
  Description of Artificial Sequence: Synthetic polypeptide
QVQLVESGGGVVQPGRSLRLSCAASGFTFSTYGMHWVRQAPGKGLEWVAVISHDGSDKYYADSVKGRFTISRDNSKNTLYLQMNSLRAEDTAVYYCARDQSIIETFDYWGQGTLVTVSS

SEQ ID NO: 5743 - protein, 118 aa, Artificial Sequence
  Description of Artificial Sequence: Synthetic polypeptide
QVQLVESGGGVVQPGRSLRLSCAVSGFTFRSYGMHWVRQAPGKGLEWVAVIWYDGSIKYYADSVKGRFTISRDNSKNTLYLQMNSLRAEDTAVYFCAREGGRDAFDIWGQGTMVTVSS

SEQ ID NO: 5744 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISDSGGSTYYADSVKGRFTISRDNSKNTLYLQMNSLRAEDTAAYYCAKEIAVALFDYWGQGTLVTVSS

SEQ ID NO: 5745 - protein, 118 aa, Artificial Sequence
  Description of Artificial Sequence: Synthetic polypeptide
QVQLVQSGGEVKKPGASVKVSCKTSGYTFTSYGISWVRQAPGQGLEWMGWISAYNGNTKYAQKLQGRLTMTTDTSTTTAYMELRSLRSDDTAVYYCARDSAAHGMDVWGQGTTVTVSS

SEQ ID NO: 5746 - protein, 120 aa, Artificial Sequence
  Description of Artificial Sequence: Synthetic polypeptide
EVKLQESGPELVKPGASVKMSCKASGYKFTDYVVHWLKQKPGQGLEWIGYINPYNDGTKYNEKFKGKATLTSDKSSSTAYMEVSSLTSEDSAVYYCARDYRYEVYGMDYWGQGTSVTVSS

SEQ ID NO: 5747 - protein, 120 aa, Artificial Sequence
  Description of Artificial Sequence: Synthetic polypeptide
EVKLQESGAELVRPGVSVKISCKGSGYTFTDYVLHWVKQSHAKSLEWIGLINTYNGDVRYNQKFMGKATMTIEKSSSTAYMELVRLTSEDSAIYYCARDYRYEYYAMDYWGQGTSVTVSS

SEQ ID NO: 5748 - protein, 117 aa, Artificial Sequence
  Description of Artificial Sequence: Synthetic polypeptide
QVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSS

SEQ ID NO: 5749 - protein, 117 aa, Artificial Sequence
  Description of Artificial Sequence: Synthetic polypeptide
QVQLVQSGAEVKKPGSSVKVSCKASGDTFSSYAISWVRQAPGQGLEWMGRIIPIINIASYAQNFQGRVTITADKSTNTAYMELSSLRSEDTAVYYCARNWADAFDIWGQGTMVTVSS

SEQ ID NO: 5750 - protein, 117 aa, Artificial Sequence
  Description of Artificial Sequence: Synthetic polypeptide
QVQLVQSGTEVKKPGSSVKVSCKVSGDTFSSYAISWVRQAPGQGLEWMGRIIPIIGIANYAQKFQGRVTITADKSTSTAYMELSSLRSEDTAVYYCARHWLDAFDIWGQGTMVTVSS

SEQ ID NO: 5751 - protein, 117 aa, Artificial Sequence
  Description of Artificial Sequence: Synthetic polypeptide
QVQLVQSGAEVKKPGSSVKVSCKASGGTFSDYAISWVRQAPGQGLEWMGRIIPILGVADYAQKFQGRVTITADKSTRTAYMELSSLRSEDTAVYYCARNWADAFDIWGQGTMVTVSS

SEQ ID NO: 5752 - protein, 117 aa, Artificial Sequence; identical to SEQ ID NO: 5751
  Description of Artificial Sequence: Synthetic polypeptide

SEQ ID NO: 5753 - protein, 117 aa, Artificial Sequence
  Description of Artificial Sequence: Synthetic polypeptide
QVELVQSGAEVQKPGSSVKVSCKASGDTFSSYAISWVRQAPGQGLEWMGRIIPIVGIVNYAEKFQGRVTITADKSMSTAYMELSSLRSEDTAVYYCARNWADAFDIWGQGTMVTVSS

SEQ ID NO: 5754 - protein, 117 aa, Artificial Sequence
  Description of Artificial Sequence: Synthetic polypeptide
QVQLVQSGAEVKKPGSSVKVACKASGDTFSSYAISWVRQAPGQGLEWMGRVIPIIGIASYAQNFQGRVTITADRSTSTAYMALSSLRSEDTAVYYCARNWADAFDIWGQGTMVTVSS

SEQ ID NO: 5755 - protein, 117 aa, Artificial Sequence; identical to SEQ ID NO: 5754
  Description of Artificial Sequence: Synthetic polypeptide

SEQ ID NO: 5756 - protein, 117 aa, Artificial Sequence
  Description of Artificial Sequence: Synthetic polypeptide
QVQLVQSGAEVKKPGSSVKVACKASGDTFSSYAISWVRQAPGQGLEWMGRVIPIIGIASYAQNFEGRVTITADRSTSTAYMALSSLRSEDTAVYYCARNWADAFDIWGQGTMVTVSS

SEQ ID NO: 5757 - protein, 119 aa, Artificial Sequence
  Description of Artificial Sequence: Synthetic polypeptide
QVELVQSGAEVKKPGSSVKVSCKASGGTFSSYAISWVRQAPGQGLEWMGRIIPILDMANYAQKFQGRVTITADKSTYTAYMELSSLRSEDTAVYYCAREGGVDWYFDLWGRGTLVTVSS

SEQ ID NO: 5758 - protein, 119 aa, Artificial Sequence
  Description of Artificial Sequence: Synthetic polypeptide
QVELVQSGAEVKKPGSSVKVSCKASEDTFSSYAISWVRQAPGQGLEWMGRIIPIIGIVNYAQKFQGRVTITADKSTYTAYMELSSLRSEDTAVYYCAREGGVDWYFDLWGRGTLVTVSS

SEQ ID NO: 5759 - protein, 119 aa, Artificial Sequence
  Description of Artificial Sequence: Synthetic polypeptide
QVELVQSGAEVKKPGSSVKVSCKASGGTFSSYAISWVRQAPGQGLEWMGRIIPILGMANYAQKFQGRVTITADKSTYTAYMELSSLRSEDTAVYYCAREGGVDWYFDLWGRGTLVTVSS

SEQ ID NO: 5760 - protein, 119 aa, Artificial Sequence
  Description of Artificial Sequence: Synthetic polypeptide
QVQLVQSGAEVKKPGSSMKVSCKASEDTFSSYAISWVRQAPGQGLEWMGRIIPIIGIVNYAQKFQGRVTITADKSTCTAYMELTSLRSEDTAVYYCAREGGVDWYFDLWGRGTLVTVSS

SEQ ID NO: 5761 - protein, 119 aa, Artificial Sequence
  Description of Artificial Sequence: Synthetic polypeptide
QVQLVQSGAEVKKPGSSVKVSCKASGGTFSSYAISWVRQAPGQGLEWMGRIIPILGIANYAQKFQGRVTITADKSTYTAYMELSSLRSEDTAVYYCAREGGVDWYFDLWGRGTLVTVSS

SEQ ID NO: 5762 - protein, 117 aa, Artificial Sequence
  Description of Artificial Sequence: Synthetic polypeptide
QVQLQQPGAEWKPGASVKMSCKASGYTFTSYYIHWIKQTPGQGLEWVGVIYPGNDDISYNQKFKGKATLTADKSSTTAYMQLSSLTSEDSAVYYCAREVRLRYFDVWGAGTTVTVSS

SEQ ID NO: 5763 - protein, 117 aa, Artificial Sequence
  Description of Artificial Sequence: Synthetic polypeptide
QVQLQQPGAEWKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSS

SEQ ID NO: 5764 - protein, 117 aa, Artificial Sequence; identical to SEQ ID NO: 5748
  Description of Artificial Sequence: Synthetic polypeptide

SEQ ID NO: 5765 - protein, 117 aa, Artificial Sequence; identical to SEQ ID NO: 5749
  Description of Artificial Sequence: Synthetic polypeptide

SEQ ID NO: 5766 - protein, 117 aa, Artificial Sequence; identical to SEQ ID NO: 5750
  Description of Artificial Sequence: Synthetic polypeptide

SEQ ID NO: 5767 - protein, 117 aa, Artificial Sequence; identical to SEQ ID NO: 5751
  Description of Artificial Sequence: Synthetic polypeptide

SEQ ID NO: 5768 - protein, 117 aa, Artificial Sequence; identical to SEQ ID NO: 5751
  Description of Artificial Sequence: Synthetic polypeptide

SEQ ID NO: 5769 - protein, 117 aa, Artificial Sequence; identical to SEQ ID NO: 5753
  Description of Artificial Sequence: Synthetic polypeptide

SEQ ID NO: 5770 - protein, 117 aa, Artificial Sequence; identical to SEQ ID NO: 5754
  Description of Artificial Sequence: Synthetic polypeptide

SEQ ID NO: 5771 - protein, 117 aa, Artificial Sequence; identical to SEQ ID NO: 5754
  Description of Artificial Sequence: Synthetic polypeptide

SEQ ID NO: 5772 - protein, 117 aa, Artificial Sequence; identical to SEQ ID NO: 5756
  Description of Artificial Sequence: Synthetic polypeptide

SEQ ID NO: 5773 - protein, 119 aa, Artificial Sequence; identical to SEQ ID NO: 5757
  Description of Artificial Sequence: Synthetic polypeptide

SEQ ID NO: 5774 - protein, 119 aa, Artificial Sequence; identical to SEQ ID NO: 5758
  Description of Artificial Sequence: Synthetic polypeptide

SEQ ID NO: 5775 - protein, 119 aa, Artificial Sequence; identical to SEQ ID NO: 5759
  Description of Artificial Sequence: Synthetic polypeptide

SEQ ID NO: 5776 - protein, 119 aa, Artificial Sequence; identical to SEQ ID NO: 5760
  Description of Artificial Sequence: Synthetic polypeptide

SEQ ID NO: 5777 - protein, 119 aa, Artificial Sequence; identical to SEQ ID NO: 5761
  Description of Artificial Sequence: Synthetic polypeptide

SEQ ID NO: 5778 - protein, 116 aa, Artificial Sequence
  Description of Artificial Sequence: Synthetic polypeptide
AVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSS

SEQ ID NO: 5779 - protein, 119 aa, Artificial Sequence
  Description of Artificial Sequence: Synthetic polypeptide
EIQLQQSGPELVKPGASVKVSCKASGYSFTDYNMYWVKQSHGKSLEWIGYIDPYNGDTTYNQKFKGKATLTVDKSSSTAFIHLNSLTSEDSAVYYCARSPYGHYAMDYWGQGTSVTVSS

SEQ ID NO: 5780 - protein, 116 aa, Artificial Sequence; identical to SEQ ID NO: 5778
  Description of Artificial Sequence: Synthetic polypeptide

SEQ ID NO: 5781 - protein, 116 aa, Artificial Sequence; identical to SEQ ID NO: 5778
  Description of Artificial Sequence: Synthetic polypeptide

SEQ ID NO: 5782 - protein, 115 aa, Artificial Sequence
  Description of Artificial Sequence: Synthetic polypeptide
QVQVQESGPGLVAPSQTLSITCTVSGFSLTTSGVSWVRQPPGKGLEWLGVIWGDGSTNYHPSLKSRLSIKKDHSKSQVFLKLNSLTAADTATYYCAKGGYSLAHWGQGTLVTVSS

SEQ ID NO: 5783 - protein, 115 aa, Artificial Sequence
  Description of Artificial Sequence: Synthetic polypeptide
QVQVQESGPGLVAPSQTLSITCTVSGFSLTTSGVSWVRQPPGKGLEWLGVIWGDGSTNYHSSLKSRLSIKKDHSKSQVFLKLNSLTAADTATYYCAKGGYSLAHWGQGTLVTVSS

SEQ ID NO: 5784 - protein, 116 aa, Artificial Sequence
  Description of Artificial Sequence: Synthetic polypeptide
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSS

SEQ ID NO: 5785 - protein, 116 aa, Artificial Sequence
  Description of Artificial Sequence: Synthetic polypeptide
AVQLVESGGGLVQPGGSLRLSCKASGYSFTGYNMNWVRQAPGKGLEWVANIDPYYGGTTYNRKVKGRFTISVDKSSSTAYLQMNSLRAEDTAVYYCARSVGPMDYWGQGTLVTVSS

SEQ ID NO: 5786 - protein, 116 aa, Artificial Sequence; identical to SEQ ID NO: 5778
  Description of Artificial Sequence: Synthetic polypeptide

SEQ ID NO: 5787 - protein, 330 aa, Artificial Sequence; identical to SEQ ID NO: 3051
  Description of Artificial Sequence: Synthetic polypeptide

SEQ ID NO: 5788 - protein, 446 aa, Artificial Sequence; identical to SEQ ID NO: 4914
  Description of Artificial Sequence: Synthetic polypeptide

SEQ ID NO: 5789 - protein, 446 aa, Artificial Sequence; identical to SEQ ID NO: 4915
  Description of Artificial Sequence: Synthetic polypeptide

SEQ ID NO: 5790 - protein, 446 aa, Artificial Sequence; identical to SEQ ID NO: 4912
  Description of Artificial Sequence: Synthetic polypeptide

SEQ ID NO: 5791 - protein, 446 aa, Artificial Sequence; identical to SEQ ID NO: 4913
  Description of Artificial Sequence: Synthetic polypeptide

SEQ ID NO: 5792 - protein, 116 aa, Artificial Sequence
  Description of Artificial Sequence: Synthetic polypeptide
AVQLVQSGAEVKKPGSSVKVSCKASGYSFTGYNMNWVRQAPGQGLEWMGNIDPYYGGTTYNRKFKGRVTLTVDKSSSTAYMELSSLRSEDTAVYYCARSVGPMDYWGQGTLVTVSS

SEQ ID NO: 5793 - protein, 116 aa, Artificial Sequence
  Description of Artificial Sequence: Synthetic polypeptide
AVQLVESGGGLVQPGGSLRLSCKASGYSFTGYNMNWVRQAPGKGLEWVGNIDPYYGGTTYNRKFKGRATLSVDKSSSTAYLQMNSLRAEDTAVYYCARSVGPMDYWGQGTLVTVSS

SEQ ID NO: 5794 - protein, 122 aa, Artificial Sequence
  Description of Artificial Sequence: Synthetic polypeptide
QVQLVQSGAEVKKPGSSVKVSCKASGGTFSSYAFSWVRQAPGQGLEWMGRVIPFLGIANSAQKFQGRVTITADKSTSTAYMDLSSLRSEDTAVYYCARDDIAALGPFDYWGQGTLVTVSSAS

SEQ ID NO: 5795 - protein, 122 aa, Artificial Sequence
  Description of Artificial Sequence: Synthetic polypeptide
EVQLVQSGAEVKKPGESLKISCKGSGYSFSNYWIGWVRQMPGKGLEWMGIIYPHDSDARYSPSFQGQVTFSADKSISTAYLQWSSLKASDTAMYYCARHVGWGSRYWYFDLWGRGTLVTVSS

SEQ ID NO: 5796 - protein, 120 aa, Artificial Sequence
  Description of Artificial Sequence: Synthetic polypeptide
QVQLVESGGGLVQPGGSLRLSCAASGFTFSSYYMNWVRQAPGKGLEWVSGISGDPSNTYYADSVKGRFTISRDNSKNTLYLQMNSLRAEDTAVYYCARDLPLVYTGFAYWGQGTLVTVSS

SEQ ID NO: 5797 - protein, 122 aa, Artificial Sequence [sequence omitted]

SEQ ID NO: 5798 - protein, 122 aa, Artificial Sequence; identical to SEQ ID NO: 5795
  Description of Artificial Sequence: Synthetic polypeptide

SEQ ID NO: 5799 - protein, 122 aa, Artificial Sequence; identical to SEQ ID NO: 5794
  Description of Artificial Sequence: Synthetic polypeptide

SEQ ID NO: 5800 - protein, 114 aa, Artificial Sequence
  Description of Artificial Sequence: Synthetic polypeptide
QIQLVQSGPELKKPGETVKISCKASGYTLTSYGMNWVKQAPGKGLKWMGWINTYTGEPTYADDFKGRFAFSLETSASTAFLQINNLKNEDTATYFCVRRGFAYWGQGTLVTVSA

SEQ ID NO: 5801 - protein, 114 aa, Artificial Sequence
  Description of Artificial Sequence: Synthetic polypeptide
QIQLVQSGPELKKPGETVKISCKASGYTFTNSGMNWVKQAPGKGLKWMGWINTYTGEPTYADDFKGRFAFSLETSASSAYLQISNLKNEDTATYFCARRGFVYWGQGTLVTVSA

SEQ ID NO: 5802 - protein, 120 aa, Artificial Sequence
  Description of Artificial Sequence: Synthetic polypeptide
QVQLQQSGAELARPGTSVKLSCKASGYTFTDYWMQWVKQRPGQGLEWIGTIYPGDGDTGYAQKFKGKATLTADKSSKTVYMHLSSLASEDSAVYYCARGDYYGSNSLDYWGQGTSVTVSS

SEQ ID NO: 5803 - protein, 119 aa, Artificial Sequence
  Description of Artificial Sequence: Synthetic polypeptide
QVQLQQSGPELVRPGASVKISCKTSGYAFSGSWMNWVKQRPGQGLEWIGRIYPGDGDIIYNGNFRDKVTLSADKSSNTAYMQLSSLTSVDSAVYFCSRWGTFTPSFDYWGQGTTLTVSS

SEQ ID NO: 5804 - protein, 117 aa, Artificial Sequence
  Description of Artificial Sequence: Synthetic polypeptide
DVKLVESGGGLVKPGGSLKLSCEASGFTFSSYTLSWVRQTPETRLEWVATISIGGRYTYYPDSVEGRFTISRDNAKNTLYLQMNSLKSEDTAMYYCTRDFNGYSDFWGQGTTLTVSS

SEQ ID NO: 5805 - protein, 120 aa, Artificial Sequence
  Description of Artificial Sequence: Synthetic polypeptide
NVQLVESGGGLVQPGGSRKLSCAASGFTFSNFGMHWVRQAPEKGLEWVAYIRSGSGTIYYSDTVKGRFTISRDNPKNTLFLQMTSLRSEDTAMYYCARSYYDFGAWFAYWGQGTLVTVSA

SEQ ID NO: 5806 - protein, 120 aa, Artificial Sequence [sequence omitted]

SEQ ID NO: 5807 - protein, 117 aa, Artificial Sequence
  Description of Artificial Sequence: Synthetic polypeptide
EVQLVESGGGLVKPGGSLRLSCEASGFTFSSYTLSWVRQTPGKGLEWVATISIGGRYTYYPDSVKGRFTISRDNAKNTLYLQMNSLKSEDTAMYYCTRDFNGYSDFWGQGTTLTVSS

SEQ ID NO: 5808 - protein, 121 aa, Artificial Sequence
  Description of Artificial Sequence: Synthetic polypeptide
QLQLQESGPGLVKPSETLSLTCTVSGGSISSSSYYWSWIRQHPGKGLEWIGYIYYSGSTNYNPSLKSRVTISVDTLKNQISLRLTSVTAADTAVYYCARVGGAGGWPMDVWGQGTTVTVSS

SEQ ID NO: 5809 - protein, 118 aa, Artificial Sequence
  Description of Artificial Sequence: Synthetic polypeptide
QVQLQESGPGLVKPSETLSLTCAVYGGSFSGYYWSWIRQPPGKGLEWIGSIYHSGSTYYNPSLKSRVTISVDTSKNQFSLKLSSVTAADTAVYYCARDLYYYYGMDVWGQGTTVTVSS

SEQ ID NO: 5810 - protein, 122 aa, Artificial Sequence
  Description of Artificial Sequence: Synthetic polypeptide
EVQLVQSGAEVKKSGASVKVSCKASGYTFTDYYIHWVRQAPGQGLEWMGWINPNNGGVTFAQKFQGRVTMTRDTSISTAYMDLSSLRSDDTAVYFCARDIRMSGWLAPFDYWGQGTLVTVSS

SEQ ID NO: 5811 - protein, 120 aa, Artificial Sequence
  Description of Artificial Sequence: Synthetic polypeptide
QVQLVESGGGVVQGGGSLRLSCAASGFTVRSNYMSWVRQAPGKGLEWVSAISGSGDSTYYADSVKGRFTISRDNSKNTLYLQMNSLRAEDTAVYYCAKVAVTTGWYFDLWGRGTLVTVSS

SEQ ID NO: 5812 - protein, 120 aa, Artificial Sequence
  Description of Artificial Sequence: Synthetic polypeptide
EVQLQQSGPEVGRPGSSVKISCKASGYTFTDYIMHWVKQSPGQGLEWIGWIDPEYGRTDYAEKFKKKATLTADTSSSTAYIQLSSLASEDTATYFCARSAHTTGFGFAYWGQGTLVTVSS

SEQ ID NO: 5813 - protein, 123 aa, Artificial Sequence
  Description of Artificial Sequence: Synthetic polypeptide
EVQLQQSGPEVGRPGSSVKISCKASGYIFTDYIMHWVKQSPGQGLEWIGWIDPEYGSTDYAEKFKKKATLTADTSSSTAYIQLSSLTSEDTATYFCARVAIITTVASGGFAYWGQGTLVTVSS

SEQ ID NO: 5814 - protein, 120 aa, Artificial Sequence
  Description of Artificial Sequence: Synthetic polypeptide
EVQLQQSGPEVGRPGSSVKISCKASGYTFTDSVMNWVKQSPGQGLEWIGWIDPEYGRTDVAEKFKKKATLTADSSSSTAYIYLSGLTSEDTATYFCARTKYNSGYGFPYWGQGSLVTVSS

SEQ ID NO: 5815 - protein, 125 aa, Artificial Sequence
  Description of Artificial Sequence: Synthetic polypeptide
QVQLVQSGAEVKKPGSSVKVSCKASGGNFISYSISWVRQAPGKRLEWMGWIIPIFGTTTYVQKFQGRVTITADESTSTAYMELSSLRSEDTAVYYCARVKYGSGSYYPNNWFDPWGQGTLVTVSS

SEQ ID NO: 5816 - protein, 123 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARDSSSWYFTYGYFQHWGQGTLVTVSS

SEQ ID NO: 5817 - protein, 124 aa, Artificial Sequence
  Description of Artificial Sequence: Synthetic polypeptide
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSAS

SEQ ID NO: 5818 - protein, 113 aa, Artificial Sequence
  Description of Artificial Sequence: Synthetic polypeptide
EVQLQQSGPDLVKPGASVKISCKASGYSFTGYYIHWVKQSHGKSLEWIGRVIPNNGGTSYNQKFKGKAILTVDKSSSTAYMELRSLTSEDSAVYYCAREGIYWWGHGTTLTVS

SEQ ID NO: 5819 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVS

SEQ ID NO: 5820 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNQGGTSYNQKFKGRFTLSVDNSKNTAYLQMNSLRAEDTAVYYCAREGIYWWGQGTLVTVS

SEQ ID NO: 5821 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRFTISRDNSKNTLYLQMNSLRAEDTAVYYCAREGIYWWGQGTLVTVS

SEQ ID NO: 5822 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRFTISVDNSKNTLYLQMNSLRAEDTAVYYCAREGIYWWGQGTLVTVS

SEQ ID NO: 5823 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRFTISRDKSKNTLYLQMNSLRAEDTAVYYCAREGIYWWGQGTLVTVS

SEQ ID NO: 5824 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRATLSVDNSKNTAYLQMNSLRAEDTAVYYCAREGIYWWGQGTLVTVS

SEQ ID NO: 5825 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRFTLSVDNSKNTAYLQMNSLRAEDTAVYYCAREGIYWWGQGTLVTVS

SEQ ID NO: 5826 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRATISVDNSKNTAYLQMNSLRAEDTAVYYCAREGIYWWGQGTLVTVS

SEQ ID NO: 5827 - protein, 113 aa, Artificial Sequence
  Description of Artificial Sequence: Synthetic polypeptide
EVQLVESGGGLVQPGGSLRLSCAASGYSFTGYYIHWVRQAPGKGLEWVARVIPNNGGTSYNQKFKGRATLSVDNSKNTLYLQMNSLRAEDTAVYYCAREGIYWWGQGTLVTVS

SEQ ID NO: 5828 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSS

SEQ ID NO: 5829 - protein, 116 aa, Artificial Sequence
  Description of Artificial Sequence: Synthetic polypeptide
EVQLLESGGGLVQPGGSLRLSCAASGFTFDAYDMQWVRQAPGKGLEWVSTITSEGLSTYYADSVKGRFTISRDNSKNTLYLQMNSLRAEDTAVYYCAKPSDLFDYWGQGTLVTVSS

SEQ ID NO: 5830 - protein, 121 aa, Artificial Sequence
  Description of Artificial Sequence: Synthetic polypeptide
EVQLLESGGGLVQPGGSLRLSCAASGFTFDGYDMGWVRQAPGKGLEWVSTISRGGWFTYYADSVKGRFTISRDNSKNTLYLQMNSLRAEDTAVYYCAKGTSQSSTGSFDYWGQGTLVTVSS

SEQ ID NO: 5831 - protein, 116 aa, Artificial Sequence
  Description of Artificial Sequence: Synthetic polypeptide
EVQLLESGGGLVQPGGSLRLSCAASGFTFRRYDMLWARQAPGKGLEWVSEISPTGALTYYADSVKGRFTISRDNSKNTLYLQMNSLRAEDTAVYYCAKLGSTFDYWGQGTLVTVSS

SEQ ID NO: 5832 - protein, 119 aa, Artificial Sequence
  Description of Artificial Sequence: Synthetic polypeptide
EVQLLESGGGLVQPGGSLRLSCAASGFTFFPYYMSWVRQAPGKGLEWVSSISGTGGLTYYADSVKGRFTISRDNSKNTLYLQMNSLRAEDTAVYYCAKTTQNATLFDYWGQGTLVTVSS

SEQ ID NO: 5833 - protein, 116 aa, Artificial Sequence
  Description of Artificial Sequence: Synthetic polypeptide
EVQLLESGGGLVQPGGSLRLSCAASGFTFEVYTMAWVRQAPGKGLEWVSTIDESGRDTYYADSVKGRFTISRDNSKNTLYLQMNSLRAEDTAVYYCAKPGVWFDYWGQGTLVTVSS

SEQ ID NO: 5834 - protein, 124 aa, Artificial Sequence
  Description of Artificial Sequence: Synthetic polypeptide
EVQLLESGGGLVQPGGSLRLSCAASGFTFAFYKMGWVRQAPGKGLEWVSTITPKGHHTYYADSVKGRFTISRDNSKNTLYLQMNSLRAEDTAVYYCAKVFKGKGWTRPSGFDYWGQGTLVTVSS

SEQ ID NO: 5835 - protein, 120 aa, Artificial Sequence
  Description of Artificial Sequence: Synthetic polypeptide
EVQLLESGGGLVQPGGSLRLSCAASGFTFNEYSMMWVRQAPGKGLEWVSSIGRRGWLTYYADSVKGRFTISRDNSKNTLYLQMNSLRAEDTAVYYCAKAVLLDSTKFDYWGQGTLVTVSS

SEQ ID NO: 5836 - protein, 124 aa, Artificial Sequence
  Description of Artificial Sequence: Synthetic polypeptide
EVQLLESGGGLVQPGGSLRLSCAASGFTFPSYDMAWVRQAPGKGLEWVSGISRSGSMTYYADSVKGRFTISRDNSKNTLYLQMNSLRAEDTAVYYCAKGVDAHVYYMEPFFDYWGQGTLVTVSS

SEQ ID NO: 5837 - protein, 121 aa, Artificial Sequence
  Description of Artificial Sequence: Synthetic polypeptide
EVQLLESGGGLVQPGGSLRLSCAASGFTFDEYPMTWVRQAPGKGLEWVSTISARGPFTYYADSVKGRFTISRDNSKNTLYLQMNSLRAEDTAVYYCAKGRHWLRNGRFDYWGQGTLVTVSS

SEQ ID NO: 5838 - protein, 116 aa, Artificial Sequence
  Description of Artificial Sequence: Synthetic polypeptide
EVQLLESGGGLVQPGGSLRLSCAASGFTFGMQSMQWVRQAPGKGLEWVSSITDDGTSTYYADSVKGRFTISRDNSKNTLYLQMNSLRAEDTAVYYCAKPDRVFDYWGQGTLVTVSS

SEQ ID NO: 5839 - protein, 116 aa, Artificial Sequence
  Description of Artificial Sequence: Synthetic polypeptide
EVQLLESGGGLVQPGGSLRLSCAASGFTFGAADMQWVRQAPGKGLEWVSLITNDGISTYYADSVKGRFTISRDNSKNTLYLQMNSLRAEDTAVYYCAKAGDRFDYWGQGTLVTVSS

SEQ ID NO: 5840 - protein, 121 aa, Artificial Sequence
  Description of Artificial Sequence: Synthetic polypeptide
EVQLLESGGGLVQPGGSLRLSCAASGFTFNKYRMQWVRQAPGKGLEWVSSIDSSGELTYYADSVKGRFTISRDNSKNTLYLQMNSLRAEDTAVYYCAEEVPMGNQTFFDYWGQGTLVTVSS

SEQ ID NO: 5841 - protein, 119 aa, Artificial Sequence
  Description of Artificial Sequence: Synthetic polypeptide
EVQLLESGGGLVQPGGSLRLSCAASGFTFTDYTMGWVRQAPGKGLEWVSSITSQGAFTYYADSVKGRFTISRDNSKNTLYLQMNSLRAEDTAVYYCAKATGTDSSFDYWGQGTLVTVSS

SEQ ID NO: 5842 - protein, 116 aa, Artificial Sequence
  Description of Artificial Sequence: Synthetic polypeptide
EVQLLESGGGLVQPGGSLRLSCAASGFTFEDYEMSWVRQAPGKGLEWVSCIGPGGKPTYYADSVKGRFTISRDNSKNTLYLQMNSLRAEDTAVYYCAKVDGHFDYWGQGTLVTVSS

SEQ ID NO: 5843 - protein, 119 aa, Artificial Sequence
  Description of Artificial Sequence: Synthetic polypeptide
EVQLLESGGGLVQPGGSLRLSCAASGFTFSQYDMGWVRQAPGKGLEWVSTISSRGWLTYYADSVKGRFTISRDNSKNTLYLQMNSLRAEDTAVYYCAKGPGGRRRFDYWGQGTLVTVSS

SEQ ID NO: 5844 - protein, 124 aa, Artificial Sequence
  Description of Artificial Sequence: Synthetic polypeptide
EVQLLESGGGLVQPGGSLRLSCAASGFTFLDYAMGWVRQAPGKGLEWVSTISPMGMGTYYADSVKGRFTISRDNSKNTLYLQMNSLRAEDTAVYYCAKSSAISFTSDISNFDYWGQGTLVTVSS

SEQ ID NO: 5845 - protein, 123 aa, Artificial Sequence
  Description of Artificial Sequence: Synthetic polypeptide
EVQLLESGGGLVQPGGSLRLSCAASGFTFSDYPMSWVRQAPGKGLEWVSSISWSGFQTYYADSVKGRFTISRDNSKNTLYLQMNSLRAEDTAVYYCAKPGVARMPTGIAFDYWGQGTLVTVSS

SEQ ID NO: 5846 - protein, 116 aa, Artificial Sequence
  Description of Artificial Sequence: Synthetic polypeptide
EVQLLESGGGLVQPGGSLRLSCAASGFTFSAYEMQWVRQAPGKGLEWVSSIDSAGTFTYYADSVKGRFTISRDNSKNTLYLQMNSLRAEDTAVYYCAEPFGMFDYWGQGTLVTVSS

SEQ ID NO: 5847 - protein, 116 aa, Artificial Sequence
  Description of Artificial Sequence: Synthetic polypeptide
EVQLLESGGGLVQPGGSLRLSCAASGFTFERYQMAWVRQAPGKGLEWVSTISSDGGGTYYADSVKGRFTISRDNSKNTLYLQMNSLRAEDTAVYYCAKPGTVFDYWGQGTLVTVSS

SEQ ID NO: 5848 - protein, 124 aa, Artificial Sequence
  Description of Artificial Sequence: Synthetic polypeptide
EVQLLESGGGLVQPGGSLRLSCAASGFTFSEYPMKWVRQAPGKGLEWVSTIDRQGDRTYYADSVKGRFTISRDNSKNTLYLQMNSLRAEDTAVYYCAKTVRRGLPRPSRYFDYWGQGTLVTVSS

SEQ ID NO: 5849 - protein, 121 aa, Artificial Sequence
  Description of Artificial Sequence: Synthetic polypeptide
EVQLLESGGGLVQPGGSLRLSCAASGFTFSDYDMGWVRQAPGKGLEWVSSISPMGTFTYYADSVKGRFTISRDNSKNTLYLQMNSLRAEDTAVYYCAKGLSVYSGLDFDYWGQGTLVTVSS

SEQ ID NO: 5850 - protein, 123 aa, Artificial Sequence
  Description of Artificial Sequence: Synthetic polypeptide
EVQLLESGGGLVQPGGSLRLSCAASGFTFSHYDMGWVRQAPGKGLEWVSDIDYIGKTTYYADSVKGRFTISRDNSKNTLYLQMNSLRAEDTAVYYCAKASDEVGVNTSKFDYWGQGTLVTVSS

SEQ ID NO: 5851 - protein, 116 aa, Artificial Sequence
  Description of Artificial Sequence: Synthetic polypeptide
EVQLLESGGGLVQPGGSLRLSCAASGFTFARYDMGWVRQAPGKGLEWVSTISPTGVLTYYADSVKGRFTISRDNSKNTLYLQMNSLRAEDTAVYYCAKGFEDFDYWGQGTLVTVSS

SEQ ID NO: 5852 - protein, 116 aa, Artificial Sequence
  Description of Artificial Sequence: Synthetic polypeptide
EVQLLESGGGLVQPGGSLRLSCAASGFTFEAYPMSWVRQAPGKGLEWVSLISHTGHATYYADSVKGRFTISRDNSKNTLYLQMNSLRAEDTAVYYCAKGHWPFDYRGQGTLITVSS

SEQ ID NO: 5853 - protein, 119 aa, Artificial Sequence
  Description of Artificial Sequence: Synthetic polypeptide
EVQLLESGGGLVQPGGSLRLSCAASGFTFEDEWMSWVRQAPGKGLEWVSDISPGGWTTYYADSVKGRFTISRDNSKNTLYLQMNSLRAEDTAVYYCAKGYRPFDEFDYWGQGTLVTVSS

SEQ ID NO: 5854 - protein, 118 aa, Artificial Sequence
  Description of Artificial Sequence: Synthetic polypeptide
EVQLLESGGGLVQPGGSLRLSCAASGVTFDAIEMSWVRQAPGKGLEWVSSISRHGEYTYYADSVKGRFTISRDNSKNTLYLQMNSLRAEDTAVYYCAEDAWSRHFDYWGQGTLVTVSS

SEQ ID NO: 5855 - protein, 116 aa, Artificial Sequence
  Description of Artificial Sequence: Synthetic polypeptide
EVQLLESGGGLVQPGGSLRLSCAASGFTFDSTDMSWVRQAPGKGLEWVSGILDNGSNTYYADSVKGRFTISRDNSKNMLYLQMNSLRAEDTAVYYCAKGARDFDYWGQGTLVTVSS

SEQ ID NO: 5856 - protein, 117 aa, Artificial Sequence
  Description of Artificial Sequence: Synthetic polypeptide
EVQLLESGGGLVQPGGSLRLSCAASGFTFGRQSMQWVRQAPGKGLEWVSSIDDDGFSTYYADSVKGRFTISRDNSKNTLYLQMNSLRAEDTAVYYCAKGDPWGFDYWGQGTLVTVSS

SEQ ID NO: 5857 - protein, 116 aa, Artificial Sequence
  Description of Artificial Sequence: Synthetic polypeptide
EVQLLESGGGLVQPGGSLRLSCTASGFTFSDTQMAWVRQAPGKGLEWVSGIDDGGVSTYYADSVKGRFTISRDNSKNTLYLQMNSLRAEDTAVYYCAKPDRHFDYWGQGTLVTVSS

SEQ ID NO: 5858 - protein, 116 aa, Artificial Sequence
  Description of Artificial Sequence: Synthetic polypeptide
EVQLLESGGGLVQPGGSLRLSCAASGFTFPKYEMAWVRQAPGKGLEWVSSIDGDGKSTYYADSVKGRFTISRDNSKNTLYLQMNSLRAEDTAVYYCAKPDQFFDYWGQGTLVTVSS

SEQ ID NO: 5859 - protein, 118 aa, Artificial Sequence
  Description of Artificial Sequence: Synthetic polypeptide
EVQLLESGGGLVQPGGSLRLSCAASGFTFGSTTMGWVRQAPGKGLEWVSVISDDGGFTYYADSVKGRFTISRDNSRNTLYLQMNSLRAEDTAVYYCAKVDGYGVFDYWGQGTLVTVSS

SEQ ID NO: 5860 - protein, 116 aa, Artificial Sequence
  Description of Artificial Sequence: Synthetic polypeptide
EVQLLESGGGLVQPGGSLRLSCAASGFTFRSGDMNWVRQAPGKGLEWVSTITNDGTSTYYADSVKGRFTISRDNSKNTLYLQMNSLRAEDTAVYYCAKSDSDFDYWGQGTLVTVSS

SEQ ID NO: 5861 - protein, 120 aa, Artificial Sequence
  Description of Artificial Sequence: Synthetic polypeptide
EVQLLESGGGLVQPGGSLRLSCAASGFTFAAYAMTWVRQAPGKGLEWVSYISPNGTATYYADSVKGRFTISRDNSKNTLYLQMNSLRAEDTAVYYCAEYVGMRWNSFDYWGQGTLVTVSS

SEQ ID NO: 5862 - protein, 116 aa, Artificial Sequence
  Description of Artificial Sequence: Synthetic polypeptide
EVQLLESGGGLVQPGGSLRLSCAASGFTFSSYEMAWVRQAPGKGLEWVSSITSLGTSTYYADSVKGRFTISRDNSKNTLYLQMNSLRAEDTAVYYCAKPGRKFDYWGQGTLVTVSS

SEQ ID NO: 5863 - protein, 116 aa, Artificial Sequence
  Description of Artificial Sequence: Synthetic polypeptide
EVQLLESGGGLVQPGGSLRLSCAASGFTFNEYEMTWVRQAPGKGLEWVSTITSEGSGTYYADSVKGRFTISRDNSKNTLYLQMNSLRAEDTAVYYCAKPNGKFDYWGQGTLVTVSS

SEQ ID NO: 5864 - protein, 116 aa, Artificial Sequence
  Description of Artificial Sequence: Synthetic polypeptide
EVQLLESGGGLVQPGGSLRLSCAASGFTFSDYEMLWVRQAPGKGLEWVSTITSEGHSTYYADSVKGRFTISRDNSKNTLYLQMNSLRAEDTAVYYCAKPGTSFDYWGQGTLVTVSS

SEQ ID NO: 5865 - protein, 116 aa, Artificial Sequence
  Description of Artificial Sequence: Synthetic polypeptide
EVQLLESGGGLVQPGGSLRLSCAASGFTFSDYEMSWVRQAPGKGLEWVSTIDSDGSFTYYADSVKGRFTISRDNSKNTLYLQMNSLRAEDTAVYYCAKPGVKFDYWGQGTLVTVSS

SEQ ID NO: 5866 - protein, 116 aa, Artificial Sequence
  Description of Artificial Sequence: Synthetic polypeptide
EVQLLESGGGLVQPGGSLRLSCAASGFTFKDYEMTWVRQAPGKGLEWVSSISSTGQSTYYADSVKGRFTISRDNSKNTLYLQMNSLRAEDTAVYYCAKPGNKFDYWGQGTLVTVSS

SEQ ID NO: 5867 - protein, 124 aa, Artificial Sequence
  Description of Artificial Sequence: Synthetic polypeptide
EVQLLESGGGLVQPGGSLRLSCAASGFTFLDYGMAWVRQAPGKGLEWVSAISPLGLSTYYADSVKSRFTISRDNSKNTLYLQMNSLRAEDTAVYYCAKEVRVGRGVHPPKFDYWGQGTLVTVSS

SEQ ID NO: 5868 - protein, 116 aa, Artificial Sequence
  Description of Artificial Sequence: Synthetic polypeptide
EVQLLESGGGLVQPGGSLRLSCAASGFTFNLYEMTWVRQAPGKGLEWVSSITSDGVSTYYADSVKGRFTISRDNSKNTLYLQMNSLRAEDTAVYYCAKAGVIFDYWGQGTLVTVSS

SEQ ID NO: 5869 - protein, 123 aa, Artificial Sequence
  Description of Artificial Sequence: Synthetic polypeptide
EVQLLESGGGLVQPGGSLRLSCAASGFTFSYYSMYWVRQAPGKGLEWVSSISPFGWGTYYADSVKGRFTISRDNSKDTLYLQMNSLRAEDTAVYYCAKYGETSGPISENFDYWGQGTLVTVSS

SEQ ID NO: 5870 - protein, 123 aa, Artificial Sequence
  Description of Artificial Sequence: Synthetic polypeptide
EVQLLESGGGLVQPGGSLRLSCAASGFTFENYAMSWVRQAPGKGLEWVSTIAPLGVPTYYADSVKGRFTISRDNSKNTLYLQMNSLRAEDTAVYYCAKKKVGAWLQSRSFDYWGQGTLVTVSS

SEQ ID NO: 5871 - protein, 120 aa, Artificial Sequence
  Description of Artificial Sequence: Synthetic polypeptide
EVQLLESGGGLVQPGGSLRLSCAASGFTFMDYEMHWVRQAPGKGLEWVSTIGASGHYTYYADSVKGRFTISRDNSKNTLYLQMNSLRAEDTAVYYCAKYLDMLLFGFDYWGQGTLVTVSS

SEQ ID NO: 5872 - protein, 116 aa, Artificial Sequence
  Description of Artificial Sequence: Synthetic polypeptide
EVQLLESGGGLVQPGGSLRLSCAASGFTFAEYEMMWARQAPGKGLEWVSRIAGNGSRTYYADSVKGRFTISRDNSKNTLYLQMNSLRAEDTAVYYCAIMLSHFDYWGQGTLVTVSS

SEQ ID NO: 5873 - protein, 121 aa, Artificial Sequence
  Description of Artificial Sequence: Synthetic polypeptide
EVQLLESGGGLVQPGGSLRLSCAASGFTFYNYDMSWVRQAPGKGLEWVSGIDSMGLVTYYADSVKGRFTISRDNSKNTLYLQMNSLRAEDTAVYYCAKGSNASDWVVFDYWGQGTLVTVSS

SEQ ID NO: 5874 - protein, 121 aa, Artificial Sequence
  Description of Artificial Sequence: Synthetic polypeptide
EVQLLESGGGLVQPGGSLRLSCAASGFTFASYHMTWVRQAPGKGLEWVSSIADTGDRTYYADSVKGRFTISRDNSKNTLYLQMNSLRAEDTAVYYCAKLRGMARVWGFDYWGQGTLVTVSS

SEQ ID NO: 5875 - protein, 123 aa, Artificial Sequence
  Description of Artificial Sequence: Synthetic polypeptide
EVQLLESGGGLVQPGGSLRLSCAASGFTFSYYDMMWVRQAPGKGLEWISSISDRGLQTYYADSVKGRFTISRDNSKNTLYLQMNSLRAEDTAVYYCAKFTEIPLDWLEVFDYWGQGTLVTVSS

SEQ ID NO: 5876 - protein, 122 aa, Artificial Sequence
  Description of Artificial Sequence: Synthetic polypeptide
EVQLLESGGGLVQPGGSLRLSCAASGFTFGSYKMLWVRQAPGKGLEWVSSITNSGTETYYADSVKGRFTISRDNSKNTLYLQMNSLRAEDTAVYYCAKSMYPDLEIVHFDYWGQGTLVTVSS

SEQ ID NO: 5877 - protein, 121 aa, Artificial Sequence
  Description of Artificial Sequence: Synthetic polypeptide
EVQLLESGGGLVQPGGSLRLSCAASGFTFETYRMSWVRQAPGKGLEWVSAIDQEGSATYYADSVKGRFTISRDNSKNTLYLQMNSLRAEDTAVYYCAKNSGTRPGLRFDYWGQGTLVTVSS

SEQ ID NO: 5878 - protein, 121 aa, Artificial Sequence
  Description of Artificial Sequence: Synthetic polypeptide
EVQLLESGGGLVQPGGSLRLSCAASGFTFSSYDMLWVRQAPGKGLEWVSRIDASGYFTYYADSVKGRFTISRDNSKNTLYLQMNSLRAEDTAVYYCAQLLKLSLNPNFDYWGQGTLVTVSS

SEQ ID NO: 5879 - protein, 120 aa, Artificial Sequence
  Description of Artificial Sequence: Synthetic polypeptide
EVQLLESGGGLVQPGGSLRLSCAASGFTFSSYAMSWVRQAPGKGLEWVSSIHNTGLSTYYADSVKGRFTISRDNSKNTLYLQMNSLRAEDTAVYYCAKGTQHRFVVFDYWGQGTLVTVSS

SEQ ID NO: 5880 - protein, 116 aa, Artificial Sequence
  Description of Artificial Sequence: Synthetic polypeptide
EVQLLESGGGLVQPGGSLRLSCTASGFTFAGYQMSWVRQAPGKGLEWVSSITNEGVSTYYADSVKGRFTISRDNSKNTLYLQMNSLRAEDTAVYYCAKPGKYFDYWGQGTLVTVSS

SEQ ID NO: 5881 - protein, 123 aa, Artificial Sequence
  Description of Artificial Sequence: Synthetic polypeptide
EVQLLESGGGLVQPGGSLRLSCAASGFTFEGYPMSWVRQAPGKGLEWVSTISPLGPDTYYADSVKGRFTISRDNSKNTLYLQMNSLRAEDTAVYYCAKLLMGEYLNSRTFDYWGQGTLVTVSS

SEQ ID NO: 5882 - protein, 116 aa, Artificial Sequence
  Description of Artificial Sequence: Synthetic polypeptide
EVQLLESGGGLVQPGGSLRLSCAASGFTFNTYSMSWVRQAPGKGLEWVSWIDADGWVTYYADSVKGRFTISRDNSKNTLYLQMNSLRAEDTAVYYCAQTGHTFDYWGQGTLVTVSS

SEQ ID NO: 5883 - protein, 116 aa, Artificial Sequence
  Description of Artificial Sequence: Synthetic polypeptide
EVQLLESGGGLVQPGGSLRLSCAASGFTFTDGEMGWARQAPGKGLEWVSRIVDPGDSTYYADSVKGRFTISRDNSKNTLYLQMNSLRAEDTAVYYCAKAGDQFDYWGQGTLVTVSS

SEQ ID NO: 5884 - protein, 116 aa, Artificial Sequence
  Description of Artificial Sequence: Synthetic polypeptide
EVQLLESGGGLVQPGGSLRLSCAASGFTFPEYEMKWVRQAPGKGLEWVSTITPSGGHTYYADSVKGRFTISRDNSKNTLYLQMNSLRAEDAAVYYCAIPLSSFDYWGRGTLVTVSS

SEQ ID NO: 5885 - protein, 123 aa, Artificial Sequence
  Description of Artificial Sequence: Synthetic polypeptide
EVQLLESGGGLVQPGGSLRLSCAASGFTFSNYVMIWVRQAPGKGLEWVSLINGAGDMTYYADSVKGRFTISRDNSKNTLYLQMNSLRAEDTAVYYCAEGGARSFGVPPNFDYWGQGTLVTVSS

SEQ ID NO: 5886 - protein, 116 aa, Artificial Sequence; identical to SEQ ID NO: 5883
  Description of Artificial Sequence: Synthetic polypeptide

SEQ ID NO: 5887 - protein, 116 aa, Artificial Sequence
  Description of Artificial Sequence: Synthetic polypeptide
EVQLLESGGGLVQPGGSLRLSCVASGFTFTLYNMSWVRQAPGKGLEWVSVISSKGDSTYYADSVKGRFTISRDNSKNTLYLQMNSLRAEDTAVYYCAQTSSVFDYWGQGTLVTVSS

SEQ ID NO: 5888 - protein, 123 aa, Artificial Sequence
  Description of Artificial Sequence: Synthetic polypeptide
EVQLLESGGGLVQPGGSLRLSCAASGFTFEAYYMSWVRQAPGKGLEWVSGIVNNGLLTYYADSVKGRFTISRDNSKNMLYLQMNSLRAEDTAVYYCAKSAVHPSYRAELFDYWGQGTLVTVSS

SEQ ID NO: 5889 - protein, 119 aa, Artificial Sequence
  Description of Artificial Sequence: Synthetic polypeptide
EVQLLESGGGLVQPGGSLRLSCAASGFTFSSYEMAWVRQAPGKGLEWVSRIEPDGSNTYYADSVKGRFTISRDNSKNTLYLQMNSLRAEDTAVYYCAKGPDNFTMFDYWGQGTLVTVSS

SEQ ID NO: 5890 - protein, 116 aa, Artificial Sequence
  Description of Artificial Sequence: Synthetic polypeptide
EVQLLESGGGLVQPGGSLRLSCAASGFTFNKYMMGWVRQAPGKGLEWVSSIDSLGHYTYYADSVKGRFTISRDNSKNTLYLQMNSLRAEDTAVYYCAEAEFPFDYWGQGTLVTVSS

SEQ ID NO: 5891 - protein, 116 aa, Artificial Sequence
  Description of Artificial Sequence: Synthetic polypeptide
EVQLLESGGGLVQPGGSLRLSCAASGFTFGEYEMVWVRQAPGKGLEWVSSITSDGLSTYYADSVKGRFTISRDNSKNTLYLQMNSLRAEDTAVYYCAKPGIRFDYWGQGTLVTVSS

SEQ ID NO: 5892 - protein, 116 aa, Artificial Sequence
  Description of Artificial Sequence: Synthetic polypeptide
EVQLLESGGGLVQPGGSLRLSCAASGFTFKRYEMTWVRQAPGKGLEWVSSISSDGSFTYYADSVKGRFTISRDNSKNTLYLQMNSLRAEDTAVYYCAEPFTEFDYWGQGTLVTVSS

SEQ ID NO: 5893 - protein, 116 aa, Artificial Sequence
  Description of Artificial Sequence: Synthetic polypeptide
EVQLLESGGGMVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGQGTQVTVSS

SEQ ID NO: 5894 - protein, 116 aa, Artificial Sequence
  Description of Artificial Sequence: Synthetic polypeptide
EVQLLESGGGMVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGQGTLVTVSS

SEQ ID NO: 5895 - protein, 116 aa, Artificial Sequence
  Description of Artificial Sequence: Synthetic polypeptide
EVQLLESGGGLVQPGGSLRLSCAASGFTFKRYEMMWVRKAPGKGLEWVSSISSDGSFTYYADSVKGRFTISRDNSENTLYLQMNSLRAEDTAVYYCADPFTEFDYWGQGTLVTVSS

SEQ ID NO: 5896 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTVSRDNSKNTLYLQMNSLRAEDTAVYYCADPFTEFDYWGQGTLVTVSS

SEQ ID NO: 5897 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNTKNTLYLQMNSLRAEDTAVYYCADPFTELDYWGHGTLVTVSS

SEQ ID NO: 5898 - protein, 116 aa, Artificial Sequence
  Description of Artificial Sequence: Synthetic polypeptide
EVQLLESGGGLVRPGGSLRLSCAASGFTFKRYEMMWVRQAPGKGLEWVSSISSDGSFTYYADSVKGRFTISRDNSKNTLYLQMNSLRAEDTAVYFCADPFTEFDYWGQGTLVTVSS

SEQ ID NO: 5899 - protein, 116 aa, Artificial Sequence
  Description of Artificial Sequence: Synthetic polypeptide
EVQLLESGGGLVQPGGSLRLSCAASGFAFKRYEMTWVRQAPGKGLEWVSSISSDGSFTYYADSVKGRFTISRDNSKNTLYLHMNSLRAEDTAVYYCADPFTEIDYWGQGTLVTVSS

SEQ ID NO: 5900 - protein, 116 aa, Artificial Sequence
  Description of Artificial Sequence: Synthetic polypeptide
EVQLLESGGGLVQPGGSLRLSCAASGFPFKRYEMTWVRQAPGKGLEWVSSISSDGSFTYYADSVKGRFTISRDNSKNTLYLQMNSLRAEDTAVYYCAEPFTEFDYRAQGTLVTVSS

SEQ ID NO: 5901 - protein, 116 aa, Artificial Sequence
  Description of Artificial Sequence: Synthetic polypeptide
EVQLLESGGGLVQPGGSLRLSCAASGFTFKRYEMSWVRQAPGKGLEWVSSISSDGSFTYYADSVKGRFTISRDNSKNTLYLQMNSLRAEDTAVYYCADPFTEIDYWGQGTQVTVSS

SEQ ID NO: 5902 - protein, 116 aa, Artificial Sequence
  Description of Artificial Sequence: Synthetic polypeptide
EVQLLESGGGLVQPGGSLRLSCAASGFTFADYDMAWVRQAPGKGLEWVSGIVDDGLMTYYADSVKGRFTISRDNSKNTLYLQMNSLRAEDTAVYYCAKPDVAFDYWGQGTLVTVSN

SEQ ID NO: 5903 - protein, 116 aa, Artificial Sequence
  Description of Artificial Sequence: Synthetic polypeptide
EVQLLESGGGLVHPGGSLRLSCAASGFTFKRYEMMWVRQAPGKGLEWVSSISSDGSFTYYADSVKGRFTISRDNSKNTLYLQMNSLRDEDTAVYYCAEPFTEFDYGGQGTLVTVSS

SEQ ID NO: 5904 - protein, 116 aa, Artificial Sequence
  Description of Artificial Sequence: Synthetic polypeptide
EVQLLESGGGWVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGQGTLVTVSS

SEQ ID NO: 5905 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGHGTLVTVSS

SEQ ID NO: 5906 - protein, 116 aa, Artificial Sequence
  Description of Artificial Sequence: Synthetic polypeptide
EVQLLESGGGLVQPGGSLRLSCAASGFTFKRYEMTWVRQAPGKGLEWVSSISSDGSFTYYADSVKGRFTISRDNSKNTLYLQMNSLRAEDTAVYYCAEPFTEIDYRGQGTLVTVSS

SEQ ID NO: 5907 - protein, 116 aa, Artificial Sequence
  Description of Artificial Sequence: Synthetic polypeptide
EVQLLESGGGLVQPGGSLRLSCAASGFTFKKYEMMWVRQAPGKGLEWVSSISSDGSFTYYADSVKGRFTISRDNSKNTLYLQMNSLRAEDTAVYYCAEPFTEFDYWGHGTLVTVSS

SEQ ID NO: 5908 - protein, 116 aa, Artificial Sequence
  Description of Artificial Sequence: Synthetic polypeptide
EVQLLESGGGLVQPGGSLRLSCAASGFTFNSYEMMWVRQAPGKGLEWVSSISSDGSFTYYADSVKGRFTISRDNSKNTLYLQMNSLRAEDTAVYYCAEPFTEFDYWGHGTLVTVSS

SEQ ID NO: 5909 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGQGTLVTVSS

SEQ ID NO: 5910 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEMDYWGHGTLVTVSS

SEQ ID NO: 5911 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGHGTLVTVSS

SEQ ID NO: 5912 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCAEPFTELDYWGHGTLVTVSS

SEQ ID NO: 5913 - protein, 123 aa, Artificial Sequence
  Description of Artificial Sequence: Synthetic polypeptide
EVQLLESGGGLVQPGGSLRLSCAASGFTFIGYAMAWVRQAPGKGLEWVSSIGPLGATTYYADSVKGRFTISRDNSKNTLYLQMNSLRAEDTAVYYCAKLPAGTSSHSVDFDYWGQGTLVTVSS

SEQ ID NO: 5914 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYAESVKGRFTISRDNSKNTLYLQMNSLRAEDTAVYYCAEPFTEFDYWGHGTLVTVSS

SEQ ID NO: 5915 - protein, 116 aa, Artificial Sequence
  Description of Artificial Sequence: Synthetic polypeptide
EVQLLESGGGLVQPGGSLRLSCAASGFTFNTYEMQWVRQAPGKGLEWVSSISSDGSFTYYADSVKGRFTISRDNSKNTLYLQMNSLRAEDTAVYYCAEPFTEFDYWGHGTLVTVSS

SEQ ID NO: 5916 - protein, 116 aa, Artificial Sequence
  Description of Artificial Sequence: Synthetic polypeptide
EVQLLESGGGLVQPGGSLRLSCAASGFTFNKYEMMWARQAPGKGLEWVSSISSDGSFTYYADSVKGRFTISRDNSRNTLYLQMNSLRAEDTAVYYCAEPFTEFDYWGHGTLVTVSS

SEQ ID NO: 5917 - protein, 116 aa, Artificial Sequence
  Description of Artificial Sequence: Synthetic polypeptide
EVQLSESGGGLVQPGGSLRLSCAASGFTFKRYEMMWVRQAPGKGLEWVSSISSDGSFTYYADSVKGRFTISRDNSKNTLYLQMNSLRAEDTAVYYCADPFTEFDYWGQGTLVTVSS

SEQ ID NO: 5918 - protein, 116 aa, Artificial Sequence
  Description of Artificial Sequence: Synthetic polypeptide
EVQLLESGGGLVQPGGSLRLSCAASGFTFKRYEMMWVRQTPGKGLEWVSSISSDGSFTYYADSVKGRFTISRDNSKNTLYLQMNSLRAEDTAVYYCAEPFTEFDYWGQGTLVTVSS

SEQ ID NO: 5919 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLEMNSMRAEDTAVYYCAEPFTEFDNWGQGTLVTVSS

SEQ ID NO: 5920 - protein, 116 aa, Artificial Sequence
  Description of Artificial Sequence: Synthetic polypeptide
EVQLLESGGGLVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYWGQGTQVTVSS

SEQ ID NO: 5921 - protein, 116 aa, Artificial Sequence
  Description of Artificial Sequence: Synthetic polypeptide
EVQLLESGGGLVQPGGSLRLSCAASGFNFKRYEMTWVRQAPGKGLEWVSSISSDGSFTYYADSVKGRFTISRDNSKNTLYLQMNSLRAEDTAVYYCADPFTEFDYWGQGTLVTVSS

SEQ ID NO: 5922 - protein, 116 aa, Artificial Sequence
  Description of Artificial Sequence: Synthetic polypeptide
EVQLLESGGDLVQPGGSLRLSCAASGFTFKRYEMMWVRQAPGKGLEWVSSISSDGSFTYYADSVKGRFTISRDNSKNTLYLQMNSLRAEDTAVYYCAEPFTEFDYRGQGTLVTVSS

SEQ ID NO: 5923 - protein, 116 aa, Artificial Sequence
  Description of Artificial Sequence: Synthetic polypeptide
EVQLLESGGGLVQPGGSLRLSCAASGFTFKRYEMSWVRQAPGKGLEWVSSISSDGSFTYYADSVKGRFTISRDNSKNTLYLQMNSLRAEDTAVYYCAEPFTEFDYWGRGTLVTVSS

SEQ ID NO: 5924 - protein, 116 aa, Artificial Sequence
  Description of Artificial Sequence: Synthetic polypeptide
EVQLLESGGGLVQPGGSLRLSCAASGFTFADYEMTWVRQAPGKGLEWVSSITSDGVSTYYADSVKGRFTISRDNSKNTLYLQMNSLRAEDTAVYYCAKPSVQFDYWGQGTLVTVSS

SEQ ID NO: 5925 - protein, 124 aa, Artificial Sequence
  Description of Artificial Sequence: Synthetic polypeptide
EVQLLESGGGLVQPGGSLRLSCAASGFTFEAYPMSWVRQAPGKGLEWVSSISPLGLWTYYADSVKGRFTISRDNSKNTLYLQMNSLRAEDTAVYYCAKLSAGAETHVYRLFDYWGQGTLVTVSS

SEQ ID NO: 5926 - protein, 122 aa, Artificial Sequence
  Description of Artificial Sequence: Synthetic polypeptide
EVQLLESGGGLVQPGGSLRLSCAASGFTFGNYEMMWVRQAPGKGLEWVSSIGVLGHTTYYADSVKGRFTISRDNSKNTLYLQMNSLRAEDTAVYYCAKLMSLRTFENLFDYWGQGTLVTVSS

SEQ ID NO: 5927 - protein, 121 aa, Artificial Sequence
  Description of Artificial Sequence: Synthetic polypeptide
EVQLLESGGGLVQPGGSLRLSCAASGFTFTKYPMAWVRQAPGKGLEWVSGIDANGNRTYYADSVKGRFTISRDNSKNTLYLQMNSLRAEDTAVYYCAEGTWRRHFAIFDYWGQGTLVTVSS

SEQ ID NO: 5928 - protein, 123 aa, Artificial Sequence
  Description of Artificial Sequence: Synthetic polypeptide
EVQLLESGGGLVQPGGSLRLSCAASGFTFDLYDMMWVRQAPGKGLEWVSSISDLGTLTYYADSVKGRFTISRDNSKNTLYLQMNSLRAEDTAVYYCAKNGFRVTSNDRRFDYWGQGTLVTVSS

SEQ ID NO: 5929 - protein, 119 aa, Artificial Sequence
  Description of Artificial Sequence: Synthetic polypeptide
EVQLLESGGGLVQPGGSLRLSCAASGFTFTGGDMWWVRQAPGKGLEWVSMIEGGGVTTYYADSVKGRFTISRDNSKNTLYLQMNSLRAEDTAVYYCAELDLRTGQFDYWGQGTLVTVSS

SEQ ID NO: 5930 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTKFDYWGQGTLVTVSS

SEQ ID NO: 5931 - protein, 118 aa, Artificial Sequence
  Description of Artificial Sequence: Synthetic polypeptide
EVQLLESGGGLVQPGGSLHLSCAASGFTFSAYTMGWVRQAPGKGLEWVSLIGDRGSWTYYADSVKGRFTISRDNSKNTLYLQMNSLRAEDTAVYFCADPSDPTKFDYWGQGTLVTVSS

SEQ ID NO: 5932 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCADPSDPTKFDYWGQGTLVTVSS

SEQ ID NO: 5933 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMSSLRAEDTAVYYCADPSDPTKFDYWGQGTLVTVSS

SEQ ID NO: 5934 - protein, 118 aa, Artificial Sequence
  Description of Artificial Sequence: Synthetic polypeptide
EVQLLESGGGLVQPGGSLRLSCAASGFTFPAYTMGWVRQAPGKGLEWVSLIGDRGSWTYYADSVKGRFTISRDDSKNTLYLQMNSLRVEDTAVYYCAEPSDPTMFVYWGQGTLVTVSS

SEQ ID NO: 5935 - protein, 121 aa, Artificial Sequence
  Description of Artificial Sequence: Synthetic polypeptide
EVQLLESGGGLVQPGGSLRLSCAASGFTFRRYVMGWVRQAPGKGLEWVSWIEADGRTTYYADSVKGRFTISRDNSKNTLYLQMNSLRAEDTAVYYCAKGLTDQHVIEFDYWGQGTLVTVSS

SEQ ID NO: 5936 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTMFVYWGQGTLVTVSS

SEQ ID NO: 5937 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCADPSDPTMFDYWGQGTLVTVSS

SEQ ID NO: 5938 - protein, 118 aa, Artificial Sequence
  Description of Artificial Sequence: Synthetic polypeptide
EVQLLESGGGMVQPGGSLRLSCAASGFTFSAYTMGWVRQAPGKGLEWVSLIGDRGSWTYYADSVKGRFTISRDNSKNTLYLQMNSMRAEDTAVYYCADPSDPTKFDYWGQGTLVTVSS

SEQ ID NO: 5939 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVTLIGDRGSWTYYADSVKGRFTISRDNSKNTLYLQMNSLRAEDTAVYYCAEPSDPTMFDYWGQGTLVTVSS

SEQ ID NO: 5940 - protein, 118 aa, Artificial Sequence
  Description of Artificial Sequence: Synthetic polypeptide
EVQLLESGGGLVQPGGSLRLSCAASGFTFTAYTMGWVRQAPGKGLEWVSLIGDRGSWTYYADSVKGRFTISRDNSKNTLYLQMNSLRAEDTAVYYCAEPSDPTKLDYWGQGTLVTVSS

SEQ ID NO: 5941 - protein, 118 aa, Artificial Sequence
  Description of Artificial Sequence: Synthetic polypeptide
EVQLSESGGGLVQPGGSLRLTCAASGFTFSAYTMGWVRQAPGKGLEWVSLIGDRGSWTYYADSVKGRFTISRDNSKNTLYLQMNSLRAEDTAVYYCADPSDPTKFVYWGQGTLVTVSS

SEQ ID NO: 5942 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCADPSDPTKFVYWGQGTLVTVSS

SEQ ID NO: 5943 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTKFVYWGQGTPVTVSS

SEQ ID NO: 5944 - protein, 117 aa, Artificial Sequence
  Description of Artificial Sequence: Synthetic polypeptide
VQLLESGGGLVQPGGSLRLSCAASGFTFSAYTMGWVRQAPGKGLEWVSLIGDRGSWTYYADSVKGRFTISRDNSRNMLYLQMKSLRAEDTAVYYCADPSDPTKFVYWGQGTQVTVSS

SEQ ID NO: 5945 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTIFRDNSKNTLYLQMNSLRAEDTAVYYCADPSDPTKFVYWGQGTLVTVSS

SEQ ID NO: 5946 - protein, 117 aa, Artificial Sequence
  Description of Artificial Sequence: Synthetic polypeptide
EVQLLESGGGLVQPGGSLRLSCAASGFTFDGYRMGWVRQAPGKGLEWVSSIAPDGNYTYYADSVKGRFTISRDNSKNTLYLQMNSLRAEDTAVYYCAKFWGMQFDYWGQGTLVTVSS

SEQ ID NO: 5947 - protein, 118 aa, Artificial Sequence
  Description of Artificial Sequence: Synthetic polypeptide
EVQLLESGGGLLQPGGSLRLSCAASGFTFSDYTMGWVRQAPGKGLEWVSLIGDRGSWTYYADSVKGRFTISRDNSKNTLYLQMNSLRAEDTAVYYCAEPSDPTKFDYWGRGTLVTVSS

SEQ ID NO: 5948 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTISRDNSKNTLYLQMNSLRAEDTAVYYCAEPSDPTKFVYWGQGTLVTVSS

SEQ ID NO: 5949 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGTWTYYADPVKGRFTISRDNSKNTLYLQMNSLRAEDTAVYYCADPSDPTKFDYWGQGTLVTVSS

SEQ ID NO: 5950 - protein, 118 aa, Artificial Sequence
  Description of Artificial Sequence: Synthetic polypeptide
EVQLLESGGGLVQPGGSLRLSCAASGFTFSAYTMGWVRQAPGKGLEWVSLIGDRGSWTYYADSVKGRFTVSRDNSKNTLYLQMNSLRAEDTAVYYCAEPSDPTKFDYWGQGTLVTVSS

SEQ ID NO: 5951 - protein, 118 aa, Artificial Sequence
  Description of Artificial Sequence: Synthetic polypeptide
EVQLLESGGGLVQPGGSLRLSCAASGFTFSAYTMGWVRQAPGMGLEWVSLIGDRGSWTYYADSVKGRFTISRDNSKNTLYLQMNSLRAEDTAVYYCAEPSDPTKFDYWGQGTLVTVSS

SEQ ID NO: 5952 - protein, 116 aa, Artificial Sequence
  Description of Artificial Sequence: Synthetic polypeptide
EVQLLESGGGLVQPGGSLRLSCAASGFTFDNYKMYWVRQAPGKGLEWVSSISEIGNLTYYADSVKGRFTISRDNSKNTLYLQMNSLRAEDTAVYYCAIALTRFDYWGQGTLVTVSS

SEQ ID NO: 5953 - protein, 122 aa, Artificial Sequence
  Description of Artificial Sequence: Synthetic polypeptide
EVQLLESGGGLVQPGGSLRLSCAASGFTFASYRMYWVRQAPGKGLEWVSYIDPPGSRTYYADSVKGRFTISRDNSKNTLYLQMNSLRAEDTAVYYCAKSLNLSFPYINFDYWGQGTLVTVSS

SEQ ID NO: 5954 - protein, 116 aa, Artificial Sequence
  Description of Artificial Sequence: Synthetic polypeptide
EVQLLESGGGLVQPGGSLRLSCAASGFTFERYEMLWVRQAPGKGLEWVSRISHSGRTTYYADSVKGRFTISRDNSKNTLYLQMNSLRAEDTAVYYCAQLDGPFDYWGQGTLVTVSS

SEQ ID NO: 5955 - protein, 122 aa, Artificial Sequence
  Description of Artificial Sequence: Synthetic polypeptide
EVQLLESGGGLVQPGGSLRLSCAASGFTFKRYYMDWVRQAPGKGLEWVSRINHNGSVTYYADSVKGRFTISRDNSKNTLYLQMNSLRAEDTAVYYCAKMPQGTSDWYYFDYWGQGTLVTVSS

SEQ ID NO: 5956 - protein, 116 aa, Artificial Sequence
  Description of Artificial Sequence: Synthetic polypeptide
EVQLLESGGGLVQPGGSLRLSCAASGFTFSKYDMSWVRQAPGKGLEWVSTILEDGLTTYYADSVKGRFTISRDNSKNTLYLQMNSLRAEDTAVYYCAKPGRLFDYWGQGTLVTVSS

SEQ ID NO: 5957 - protein, 120 aa, Artificial Sequence
  Description of Artificial Sequence: Synthetic polypeptide
EVQLLESGGGLVQPGGSLRLSCAASGFTFASYPMGWVRQAPGKGLEWVSSIGPIGFTTYYADSVKGRFTISRDNSKNTLYLQMNSLRAEDTAVYYCAEMKSPYKPQFDYWGQGTLVTVSS

SEQ ID NO: 5958 - protein, 116 aa, Artificial Sequence
  Description of Artificial Sequence: Synthetic polypeptide
EVQLLESGGGLVQPGGSLRLSCAASGFTFSDYPMTWVRQAPGKGLEWVSTILSPGTETYYADSVKGRFTISRDNSKNTLYLQMNSLRAEDTAVYYCAKAEKDFDYWGQGTLVTVSS

SEQ ID NO: 5959 - protein, 116 aa, Artificial Sequence
  Description of Artificial Sequence: Synthetic polypeptide
EVQLLESGGGLVQPGGSLRLSCAASGFTFEGGEMGWVRQAPGKGLEWVSMIPMDGSATYYADSVKGRFTISRDNSKNTLYLQMNSLRAEDTAVYYCAKAGEVFDYWGQGTLVTVSS

SEQ ID NO: 5960 - protein, 116 aa, Artificial Sequence
  Description of Artificial Sequence: Synthetic polypeptide
EVQLLESGGGLVQPGGSLRLSCAASGFTFREYHMKWARQAPGKGLEWVSGISRDGMNTYYADSVKGRFTISRDNSKNTLYLQMNSLRAEDTAVYYCAIQLALFDYWGQGTLVTVSS

SEQ ID NO: 5961 - protein, 121 aa, Artificial Sequence
  Description of Artificial Sequence: Synthetic polypeptide
EVQLLESGGGLVQPGGSLRLSCAASGFTFRDYEMLWARQAPGKGLEWVSGILPSGGATYYADSVKGRFTISRDNSKNTLYLQMNSLRAEDTAVYYCAKAGSGNGPILFDYWGQGTLVTVSS

SEQ ID NO: 5962 - protein, 122 aa, Artificial Sequence
  Description of Artificial Sequence: Synthetic polypeptide
EVQLLESGGGLVQPGGSLRLSCAASGFTFKEHDMFWVRQAPGKGLEWVSGIGAEGVWTYYADSVKGRFTISRDNSKNTLYLQMNSLRAEDTAVYYCAEPTMSNGSQSRFDYWGQGTLVTVSS

SEQ ID NO: 5963 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGIIEDGNRTYYADSVKGRFTISRDNSKNTLYLQMNSLRAEDTAVYYCAKIRNLHWDVGRQFDYWGQGTLVTVSS

SEQ ID NO: 5964 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSKNTLYLQMNSLRAEDTAVYYCAKIRNLHWDVGRQFDYWGQGTLVTVSS

SEQ ID NO: 5965 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSKNTLYLQMNNLRAEDTAVYYCAKIRNLHWDVGRQFDYWGQGTLVTVSS

SEQ ID NO: 5966 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGNRTYYADSVKGRFTISRDNFKNTLYLQMNSLRAEDTAVYYCAKIRNLHWDVGRQFDYWGQGTLVTVSS

SEQ ID NO: 5967 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSMNTLYLQMNSLRAEDTAVYYCAKIRNLHWDVGRQFVYWGQGTLVTVSS

SEQ ID NO: 5968 - protein, 120 aa, Artificial Sequence
  Description of Artificial Sequence: Synthetic polypeptide
EVQLLESGGGLVQPGGSLRLSCAASGFTFLAYWMVWVRQAPGKGLEWVSSISPSGTHTYYADSVKGRFTISRDNSKNTLYLQMNSLRVEDTAVYYCAKYTEPGLGSFDYWGQGTLVTVSS

SEQ ID NO: 5969 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGIIEDGNRTYYADSVKGRFTISRDNSKNTLYLQMNSLRAEDTAVYYCAKIRNLHWDVGRQFDYWGQGTLVTVSS

SEQ ID NO: 5970 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGNRTYYADSVKGRFTISRDNSKNTLYLQMNSLRAEDTAVYYCAKIRNLHWDVGRQFDYWGQGTLVTVSS

SEQ ID NO: 5971 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGNRTYYADSVKGRFTISRDNSKNALYLQMNSLRAEDTAVYYCAKIRNLHWDVGRQFDYWGLGTLVTVSS

SEQ ID NO: 5972 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNTKNTLYLQMNSLRAEDTAVYYCAKIRNLHWDVGRQFVYWGQGTLVTVSS

SEQ ID NO: 5973 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGIIEDGNRTYYADSVKGRFTISRDNSKNRLYLQMNSLRAEDTAVYYCAKIRNLHWDVGRQFDYWGQGTLVTVSS

SEQ ID NO: 5974 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFTISRDNSKNTLYLQMNSLRAEDTAVYHCAKIRNLHWDVGRQFDYWGQGTLVTVSS

SEQ ID NO: 5975 - protein, 123 aa, Artificial Sequence
  Description of Artificial Sequence: Synthetic polypeptide
EVQLLESGGGLVQPEGSLRLSCAASGFTFDNTEMAWVRQAPGKGLEWVSGIIEDGNRTYYADSVKGRFTISRDNSKNTLYLQMNSLRAEDTAVYYCAKIRNLHWDVGRQFDYWGQGTLVTVSS

SEQ ID NO: 5976 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGISEDGNRTYYADSVKGRFTISRDNSKNTLYLQMNSLRAEDSAVYYCAKIRNLHWDVGRQFVYWGQGTLVTVSS

SEQ ID NO: 5977 - protein, 123 aa, Artificial Sequence
  Description of Artificial Sequence: Synthetic polypeptide
EVQLLESGGGLVEPGGSLRLSCAASGFTFDNTEMAWVRQAPGKGLEWVSGITEDGNRTYYADSVKGRFTISRDNSKNTLYLQMSSLRAEDTAVYYCAKIRNLHWDVGRQFDYWGQGTLVTVSS

SEQ ID NO: 5978 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGISEDGNRTYYADSVKGRFTISRDNSKNTLYLQMNSLRAEDTAVYHCAKIRNLHWDVGRQFDYWGQGTLVTVSS

SEQ ID NO: 5979 - protein, 119 aa, Artificial Sequence
  Description of Artificial Sequence: Synthetic polypeptide
EVQLLESGGGLVQPGGSLRLSCAASGFTFSNYEMGWVRQAPGKGLEWVSVISEVGSLTYYADSVKGRFTISRDNSKNTLYLQMNSLRAEDTAVYYCAKPHDSSIGFDYWGQGTLVTVSS

SEQ ID NO: 5980 - protein, 123 aa, Artificial Sequence
  Description of Artificial Sequence: Synthetic polypeptide
EVQLLESGGGLVQPGGSLRLSCAASGFTFDNTEMAWVRQAPGKGLEWVSGITEDGNRTYYADSVKGRFIISRDNSKNTLNLQMNSLRAEDTAVYYCAKIRNLHWDVGRQFDYWGQGTLVTVSS

SEQ ID NO: 5981 - protein, 123 aa, Artificial Sequence
  Description of Artificial Sequence: Synthetic polypeptide
EVQLLESGGGLVQPGGSLRLSCAASGFTFDNTEMAWIRQAPGRGLEWVSGVTEDGNRTYYADSVKGRFTISRDNSKNTLYLQMNSLRAEDTAVYYCAKIRNLHWDVGRQFDYWGQGTLVTVSS

SEQ ID NO: 5982 - protein, 123 aa, Artificial Sequence
  Description of Artificial Sequence: Synthetic polypeptide
EVQLLESGGGLVQPGGSLRLSCEASGFTFDNTEMAWIRQAPGKGLEWVSGIIEDGNRTYYADSVKGRFTISRDNTKNTLYLQMNSLRAEDTAVYYCAKIRNLHWDVGRQFDYWGQGTLVTVSS

SEQ ID NO: 5983 - protein, 123 aa, Artificial Sequence
  Description of Artificial Sequence: Synthetic polypeptide
EVQLLESGGGLVQPGGSLRLSCAASGFTFDNTEMAWIRQAPGKGLEWVSGITEDGDRTYYADSVKGRFTISRDNSKSSLYLQMNSLRAEDTAVYYCAKIRNLHWDVGRQFDYWGQGTLVTVSS

SEQ ID NO: 5984 - protein, 123 aa, Artificial Sequence
  Description of Artificial Sequence: Synthetic polypeptide
EVQLLESGGGSVQPGGSLRLSCAASGFTFDNTEMAWVRQAPGKGLEWVSGITEDGNRTYYADSVKGRFTISRDNSKNTLYLQMNSLRAEDTAVYYCAKIRNLHWDVGRQFVYWGQGTLVTVSS

SEQ ID NO: 5985 - protein, 123 aa, Artificial Sequence
  Description of Artificial Sequence: Synthetic polypeptide
EVQLLESGGGLVQPGGSLRLSCAASGFTFGSAEMGWVRQAPGKGLEWVSGISRPGQVTYYADSVKGRFTISRDNSKNTLYLQMNSLRAEDTAVYYCAKIRNLHWDVGRQFDYWGQGTLVTVSS

SEQ ID NO: 5986 - protein, 119 aa, Artificial Sequence
  Description of Artificial Sequence: Synthetic polypeptide
EVQLLESGGGLVQPGGSLRLSCAASGFTFDDGTMGWARQAPGKGLEWVSLILPSGSRTYYADSVKGRFTISRDNSKNTLYLQMNSLRAEDTAVYYCAKHSLTNRPFDYWGQGTLVTVSS

SEQ ID NO: 5987 - protein, 116 aa, Artificial Sequence
  Description of Artificial Sequence: Synthetic polypeptide
EVQLLESGGGLVQPGGSLRLSCAASGFTFSKYDMRWARQAPGKGLEWVSDIDAVGTRTYYADSVKGRFTISRDNSKNTLYLQMNSLRAEDTAVYYCAIPGGTFDYWGQGTLVTVSS

SEQ ID NO: 5988 - protein, 116 aa, Artificial Sequence
  Description of Artificial Sequence: Synthetic polypeptide
EVQLLESGGGLVQPGGSLRLSCAASGFTFEMYGMMWARQAPGKGLEWVSSIEGAGHATYYADSVKGRFTISRDNSKNTLYLQMNSLRAEDTAVYYCAIVLGMFDYWGQGTLVTVSS

SEQ ID NO: 5989 - protein, 124 aa, Artificial Sequence
  Description of Artificial Sequence: Synthetic polypeptide
EVQLLESGGGLVQPGGSLRLSCAASGFTFLQYPMGWVRQAPGKGLEWVSTISPVGLTTYYADSVKGRFTISRDNSKNTLYLQMNSLRAEDTAVYYCAKLFEGSRIQRDVGFDYWGQGTLVTVSS

SEQ ID NO: 5990 - protein, 116 aa, Artificial Sequence
  Description of Artificial Sequence: Synthetic polypeptide
EVQLLESGGGLVQPGGSLRLSCAASGFTFWSYDMTWVRQAPGKGLEWVSSIMASGDDTYYADSVKGRFTISRDNSKNTLYLQMNSLRAEDTAVYYCAKWDRDFDYWGQGTLVTVSS

SEQ ID NO: 5991 - protein, 123 aa, Artificial Sequence
  Description of Artificial Sequence: Synthetic polypeptide
EVQLLESGGGLVQPGGSLRLSCAASGFTFEKYQMGWARQAPGKGLEWVSSIRGSGLVTYYADSVKGRFTISRDNSKNTLYLQMNSLRAEDTAVYYCAKVHTTLHTEVIGFDYWGQGTLVTVSS

SEQ ID NO: 5992 - protein, 116 aa, Artificial Sequence
  Description of Artificial Sequence: Synthetic polypeptide
EVQLLESGGGLVQPGGSLRLSCAASGFTFSQYTMYWARQAPGKGLEWVSEISHSGSNTYYADSVKGRFTISRDNSKNTLYLQMNSLRAEDTAVYYCAISGLHFDYWGQGTLVTVSS

SEQ ID NO: 5993 - protein, 120 aa, Artificial Sequence
  Description of Artificial Sequence: Synthetic polypeptide
EVQLLESGGGLVQPGGSLRLSCAASGFTFSDYAMAWVRQAPGKGLEWVSRIGVEGGDTYYADSVKGRFTISRDNSKNTLYLQMNSLRAEDTAVYYCAKLLRLYRLGFDYWGQGTLVTVSS

SEQ ID NO: 5994 - protein, 121 aa, Artificial Sequence
  Description of Artificial Sequence: Synthetic polypeptide
EVQLLESGGGLVQPGGSLRLSCAASGFTFAKYDMTWVRQAPGKGLEWVSKINSDGGLTYYADSVKGRFTISRDNSKNTLYLQMNSLRAEDTAVYYCAKGLHGRGFVIFDYWGQGTLVTVSS

SEQ ID NO: 5995 - protein, 124 aa, Artificial Sequence
  Description of Artificial Sequence: Synthetic polypeptide
EVQLLESGGGLVQPGGSLRLSCAASGFTFSRYDMVWVRQAPGKGLEWVSRINSMGLATYYADSVKGRFTISRDNSKNTLYLQMNSLRAEDTAVYYCAKDYSVAPHGYPLGFDYWGQGTLVTVSS

SEQ ID NO: 5996 - protein, 122 aa, Artificial Sequence
  Description of Artificial Sequence: Synthetic polypeptide
EVQLLESGGGLVQPGGSLRLSCAASGFTFKDYSMMWVRQAPGKGLEWVSTITDNGTSTYYADSVKGRFTISRDNSKNTLYLQMNSLRAEDTAVYYCAKHMSLATYLQFFDYWGQGTLVTVSS

SEQ ID NO: 5997 - protein, 123 aa, Artificial Sequence
  Description of Artificial Sequence: Synthetic polypeptide
EVQLLESGGGLVQPGGSLRLSCAASGFTFMEYDMLWVRQAPGKALEWVSRISSDGLWTYYADSVKGRFTISRDNSKNTLYLQMNSLRAEDTAVYYCAKGVSALAPFDIGFDYWGQGTLVTVSS

SEQ ID NO: 5998 - protein, 121 aa, Artificial Sequence
  Description of Artificial Sequence: Synthetic polypeptide
EVQLLESGGGLVQPGGSLRLSCAASGFTFKEYNMAWVRQAPGKGLEWVSSINFAGRTTYYADSVKGRFTISRDNSKNTLYLQMNSLRAEDTAVYYCAKLSLPLDIFSFDYWGQGTLVTVSS

SEQ ID NO: 5999 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLYLQMNSLRAEDTAVYYCAETSGYFDYWGQGTLVTVSS

SEQ ID NO: 6000 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNMLYLRMNSLRAEDTAVYYCAETSGYYEYWGQGTLVTVSS

SEQ ID NO: 6001 - protein, 120 aa, Artificial Sequence
  Description of Artificial Sequence: Synthetic polypeptide
EVQLLESGGGLVQPGGSLRLSCAASGFTFEEYVMSWVRQAPGKGLEWVSTISPIGLTTYYADSVKGRFTISRDNSKNTLYLQMNSLRAEDTAVYYCAEFPLIILPDFDYWGQGTLVTVSS

SEQ ID NO: 6002 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLYLQMNSLRAEDTAVYYCAETSGYFEYWGQGTLVTVSS

SEQ ID NO: 6003 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLYLQMNSLRAEDTAVYYCAETSSYFEYWGQGTLVTVSS

SEQ ID NO: 6004 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFTYYADSVKGRFTISRDNSKNTLFLQMNSLRAEDTAVYYCAETSGYYEYWGHGTLVTVSS

SEQ ID NO: 6005 - protein, 116 aa, Artificial Sequence
  Description of Artificial Sequence: Synthetic polypeptide
EVQLLESGGGLVQPGGSLRLSCAASGFAFGDYGMNWVRQAPGKGLEWVSHISSNGRFTYYADSVKGRFTISRDNSKNTLYLQMNSLRAEDTAVYYCAETSGYFEYWGQGTLVTVSS

SEQ ID NO: 6006 - protein, 116 aa, Artificial Sequence
  Description of Artificial Sequence: Synthetic polypeptide
EVQLLESGGGLVQPGGSLRLSCAASGFTFGDYGMNWVRQAPGKGLEWVSHISSNGRFIYYADSVKGRFTISRDNSKNTLYLQMNSLRAEDTAVYYCAETSGYFEYWGQGTLVTVSS

SEQ ID NO: 6007 - protein, 116 aa, Artificial Sequence
  Description of Artificial Sequence: Synthetic polypeptide
EVQLLESGGGLVQPGGSLRLSCAASGFTFREYVMGWVRQAPGKGLEWVSTINGLGNVTYYADSVKGRFTISRDNTKNTLYLQMNSLRAEETAVYYCAIQLPNFDYWGQGTLVTVSS

SEQ ID NO: 6008 - protein, 119 aa, Artificial Sequence
  Description of Artificial Sequence: Synthetic polypeptide
EVQLLESGGGLVQPGGSLRLSCAASGFTFGNDGMWWVRQAPGKGLEWVSFINVDGRETYYADSVKGRFTISRDNSKNTLYLQMNSLRAEDTAVYYCAEWSPGRVQFDYWGQGTLVTVSS

SEQ ID NO: 6009 - protein, 119 aa, Artificial Sequence
  Description of Artificial Sequence: Synthetic polypeptide
EVQLLESGGGLVQPGGSLRLSCAASGFTFGGWDMAWVRQAPGKGLEWVSSIAHEGGETYYADSVKGRFTISRDNSKNTLYLQMNSLRAEDTAVYYCAKYVPGSPLFDYWGQRTLVTVSS

SEQ ID NO: 6010 - protein, 116 aa, Artificial Sequence
  Description of Artificial Sequence: Synthetic polypeptide
EVQLLESGGGLVQPGGSLRLSCAASGFTFDQGWMYWVRQAPGKGLEWVSGIGSNGPRTSYADSVKGRFTISRDNSKNTLYLQMNSLRAEDTAVYYCAKSGEYFDYWGQGTLVTVSS

SEQ ID NO: 6011 - protein, 117 aa, Artificial Sequence
  Description of Artificial Sequence: Synthetic polypeptide
EVQLLESGGGLVQPGGSLRLSCAASGFTFRQSDMWWVRQAPGKGLEWVSVIGNNGEFTYYADSVKGRFTISRDNSKNTLYLQMNSLRAEDTAVYYCAKDNWLLFDYWGQGTLVTVSS

SEQ ID NO: 6012 - protein, 123 aa, Artificial Sequence
  Description of Artificial Sequence: Synthetic polypeptide
EVQLLESGGGLVQPGGSLRLSCAASGFTFMEYAMIWVRQAPGKGLEWVSIISPLGLSTYYADSVKGRFTISRDNSKNTLYLQMNSLRAEDTAVYYCAKYQDSSDSQYTNFDYWGQGTLVTVSS

SEQ ID NO: 6013 - protein, 116 aa, Artificial Sequence
  Description of Artificial Sequence: Synthetic polypeptide
EVQLLESGGGLVQPGGSLRLSCAASGFTFDLSTMYWVRQAPGKGLEWVSTIGGDGSHTYYADSVKGRFTISRDNSKNTLYLQMNSLRAEDTAVYYCAEGTQYFDYWGQGTLVTVSS

SEQ ID NO: 6014 - protein, 116 aa, Artificial Sequence
  Description of Artificial Sequence: Synthetic polypeptide
EVQLLESGGGLVQPGGSLRLSCAASGFTFSAYTMEWVRQAPGKGLEWVSSIGVTGYDTYYADSVKGRFTISRDNSKNTLYLQMNSLRAEDTAVYYCAKGGQGFDYWGQGTLVTVSS

SEQ ID NO: 6015 - protein, 124 aa, Artificial Sequence
  Description of Artificial Sequence: Synthetic polypeptide
EVQLLESGGGLVQPGGSLRLSCAASGFTFGDYGMSWVRQAPGKGLEWVSYIDPLGRLTYYADSVKGRFTISRDNSKNTLYLQMNSLRAEDTAVYYCAEDLSSLQYGVSPNFDYWGQGTLVTVSS

SEQ ID NO: 6016 - protein, 121 aa, Artificial Sequence
  Description of Artificial Sequence: Synthetic polypeptide
EVQLLESGGGLVQPGGSLRLSCAASGFTFFHYSMSWVRQAPGKGLEWVSSIGPVGRETYYADSVKGRFTISRDNSKNTLYLQMNSLRAEDTAVYYCAKMIQSPLFKDFDYWGQGTLVTVSS

SEQ ID NO: 6017 - protein, 120 aa, Artificial Sequence
  Description of Artificial Sequence: Synthetic polypeptide
EVQLLESGGGLVQPGGSLRLSCAASGFTFEWYDMYWVRQAPGKGLEWVSRIDSGGNQTYYADSVKGRFTISRDNSKNTLYLQMNSLRAEDTAVYYCAEASLWKWRLFDYWGQGTLVTVSS

SEQ ID NO: 6018 - protein, 122 aa, Artificial Sequence
  Description of Artificial Sequence: Synthetic polypeptide
EVQLLESGGGLVQPGGSLRLSCAASGFTFEEYGMAWVRQAPGKGLEWVSTISPLGISTYYADSVKGRFTISRDNSKNTLYLQMNSLRAEDTAVYYCAKHATSQESLRSFDYWGQGTLVTVSS

SEQ ID NO: 6019 - protein, 123 aa, Artificial Sequence
  Description of Artificial Sequence: Synthetic polypeptide
EVQLLESGGGLVQPGGSLRLSCAASGFTFSKYEMMWVRQAPGKGLEWVSAISGSGGSTYYADSVKGRFTISRDNSKNTLYLQMNSLRAEDTAVYYCAKGPLPDAFWTRGFDYWGQGTLVTVSS

SEQ ID NO: 6020 - protein, 121 aa, Artificial Sequence
  Description of Artificial Sequence: Synthetic polypeptide
EVQLLESGGGLVQPGGSLRLSCAASGFTFGTYSMAWVRQAPGKGLEWVSTIDRHGLATYYADSVKGRFTISRDNSKNTLYLQMNSLRAEDTAVYYCAKTPGSSWQTVFGYWGQGTLVTVSS

SEQ ID NO: 6021 - protein, 121 aa, Artificial Sequence
  Description of Artificial Sequence: Synthetic polypeptide
EVQLLESGGGLVQPGGSLRLSCAASGFTFESYPMGWVRQAPGKGLEWVSSIDHHGHSTYYADSAKGRFTISRDNSKNTLYLQMNSLRAEDTAVYYCAKLLRVSMIFGFDYWGQGTLVTVSS

SEQ ID NO: 6022 - protein, 116 aa, Artificial Sequence
  Description of Artificial Sequence: Synthetic polypeptide
EVQLLESGGGLVQPGGSLRLSCAASGFTFVQYGMSWVRQAPGKGLEWVSWISSSGTYTYYADSVKGRFTISRDNSKNTLYLQMNSLRAEDTAVYYCAETSRMFDYWGQGTLVTVSS

SEQ ID NO: 6023 - protein, 121 aa, Artificial Sequence
  Description of Artificial Sequence: Synthetic polypeptide
EVQLLESGGGLVQPGGSLRLSCAASGFTFEDYGMGWARQAPGKGLEWVSSIGPLGLWTYYADSAKGRFTISRDNSKNTLYLQMNSLRAEDTAVYYCAKSPLEGLITNFDYWGQGTLVTVSS

SEQ ID NO: 6024 - protein, 121 aa, Artificial Sequence
  Description of Artificial Sequence: Synthetic polypeptide
EVQLLESGGGLVQPGGSLRLSCAASGFTFREYDMGWVRQAPGKGLEWVSLISPPGRTTYYADSVKGRFTISRDNSKNTLYLQMNSLRAEDTAVYYCAKVVILGYTNRFDYWGQGTLVTVSS

SEQ ID NO: 6025 - protein, 124 aa, Artificial Sequence
  Description of Artificial Sequence: Synthetic polypeptide
EVQLLESGGGLVQPGGSLRLSCAASGFTFPNYGMLWVRQAPGKGLEWVSSINSSGMETYYADSVKGRFTISRDNSKNTLYLQMNSLRAEDTAVYYCAKFFRLNDHNSVFGFDYWGQGTLVTVSS

SEQ ID NO: 6026 - protein, 116 aa, Artificial Sequence
  Description of Artificial Sequence: Synthetic polypeptide
EVQLLESGGGLVQPGGSLRLSCAASGFTFKDYKMMWIRQAPGKGLEWVSSIVGSGSMTYYADSVKGRFTISRDNSKNTLYLQMNSLRAEDTAVYYCAKGPGYFDYWGQGTLVTVSS

SEQ ID NO: 6027 - protein, 120 aa, Artificial Sequence
  Description of Artificial Sequence: Synthetic polypeptide
EVQLLESGGGLVQPGGSLRLSCAASGFTFHNYAMGWVRRAPGKGLEWVSSIDEHGTITYYADSVKGRFTISRDNSKNTLYLQMNSLRAEDTAVYYCAKDSLDRVWIFDYWGQGTLVTVSS

SEQ ID NO: 6028 - protein, 122 aa, Artificial Sequence
  Description of Artificial Sequence: Synthetic polypeptide
EVQLLESGGGLVQPGGSLRLSCAASGFTFADYPMTWVRQAPGKGLEWVSSIYSAGSPTYYADSVKGRFTISRDNSKNTLYLQMNSLRAEDTAVYYCAKLYHREPILFGFDYWGQGTLVTVSS

SEQ ID NO: 6029 - protein, 116 aa, Artificial Sequence
  Description of Artificial Sequence: Synthetic polypeptide
EVQLLESGGGLVQPGGSLRLSCAASGFTFERYQMAWVRQAPGKGLEWVSTISSDGGGTYYADSVKGRFTISRDNSKNTLYLQMNSLRAEDTAVYYCAKPGHRFDYWGQGTLVTVSS

SEQ ID NO: 6030 - protein, 119 aa, Artificial Sequence
  Description of Artificial Sequence: Synthetic polypeptide
EVQLLESGGGLVQPGGSLRLSCAASGFTFGSYTMMWVRQAPGKGLEWVSEIDRTGERTYYADSVKGRFTISRDNSKNTLYLQMNSLRAEDTAVYYCAEPGFASLPFDYWGQGTLVTVSS

SEQ ID NO: 6031 - protein, 116 aa, Artificial Sequence
  Description of Artificial Sequence: Synthetic polypeptide
EVQLLESGGGLVQPGGSLRLSCAASGFTFTDYTMYWVRQAPGKGLEWVSKISPSGRSTYYADSVKGRFTISRDNSKNTLYLQMNSLRAEDTAVYYCAKDPFGFDYWGQGTLVTVSS

SEQ ID NO: 6032 - protein, 119 aa, Artificial Sequence
  Description of Artificial Sequence: Synthetic polypeptide
EVQLLESGGGLVQPGGSLRLSCAASGFTFDDAEMFWVRQAPGKGLEWVSSIDARGLTTYYADPVKGRFTISRDNSKNTLYLQMNSLRAEDTAVYYCAEATSAMYPFDYWGQGTLVTVSS

SEQ ID NO: 6033 - protein, 121 aa, Artificial Sequence
  Description of Artificial Sequence: Synthetic polypeptide
EVQLLESGGGLVQPGGSLRLSCAASGFTFRDYDMGWVRQAPGKGLEWVSTISPLGHFTYYADSVKGRFTISRDNSKNTLYLQMNSLRAEDTAVYYCAKSGFHEYTEGFDYWGQGTLVTVSS

SEQ ID NO: 6034 - protein, 119 aa, Artificial Sequence
  Description of Artificial Sequence: Synthetic polypeptide
EVQLLESGGGLVQPGGSLRLSCAASGFTFDAYEMGWVRQAPGKGLEWVSIIDWDGNSTYYADSVKGRFTISRDNSKNTLYLQMNSLRAEDTAVYYCAKPGDNVGIFDYWGQGTLVTVSS

SEQ ID NO: 6035 - protein, 123 aa, Artificial Sequence
  Description of Artificial Sequence: Synthetic polypeptide
EVQLLESGGGLVQPGGSLRLSCAASGFTFDRAGMGWVRQAPGKGLEWVSLIGRGGDITYYADSVKGRFTISRDNSKNTLYLQMNSLRAEDTAVYYCAKIRNLHWDVGRQFDYWGQGTLVTVSS

SEQ ID NO: 6036 - protein, 116 aa, Artificial Sequence
  Description of Artificial Sequence: Synthetic polypeptide
EVQLLESGGGLVQPGGSLRLSCAASGFTFGRYQMAWVRQAPGKGLEWVSSISSDGGGTYYADSVKGRFTISRDNSKNTLYLQMNSLRAEDTAVYYCAKPSRRFDYWGQGTLVTVSS

SEQ ID NO: 6037 - protein, 123 aa, Artificial Sequence
  Description of Artificial Sequence: Synthetic polypeptide
EVQLLESGGGLVQPGGFLRLSCAASGFTFELYPMAWVRQAPGKGLEWVSSISPVGFLTYYADSVKGRFTISRDNSKNTLYLQMNSLRAEDTAVYYCAKGHEGSYTPRSAFDYWGQGTLVTVSS

SEQ ID NO: 6038 - protein, 123 aa, Artificial Sequence
  Description of Artificial Sequence: Synthetic polypeptide
EVQLLESGGGLVQPGGSLRLSCAASGFTFVAYPMAWVRQAPGKGLEWVSTIAPLGGNTYYADSVKGRFTISRDNSKNTLYLQMNSLRAEDTAVYYCAKRPEGLQIDSQNFDYWGQGTLVTVSS

SEQ ID NO: 6039 - protein, 116 aa, Artificial Sequence
  Description of Artificial Sequence: Synthetic polypeptide
EVQLLESGGGLVQPGGSLRLSCAASGFTFALYQMAWVRQAPGKGLEWVSSIDSSGSDTYYADSVKGRFTISRDNSKNTLYLQMNSLRAEDTAVYYCAKPERDFDYWGQGTLVTVSS

SEQ ID NO: 6040 - protein, 116 aa, Artificial Sequence
  Description of Artificial Sequence: Synthetic polypeptide
EVQLLESGGGLVQPGGSLRLSCAASGFTFRQYQMAWARQAPGKGLEWVSTIASDGVSTYYADSVKGRFTISRDNSKNTLYLQMNSLRAEDTAVYYCAKVGRDFDYWGQGTLVTVSS

SEQ ID NO: 6041 - protein, 116 aa, Artificial Sequence
  Description of Artificial Sequence: Synthetic polypeptide
EVQLLESGGGLVQPGGSLRLSCAASGFTFEQYDMRWVRQAPGKGLEWVSWIDEAGHETYYADSVKGRFTISRDNSRNTLYLQMNSLRAEDTAVYYCAKGMDGFDYWGQGTLVTVSS

SEQ ID NO: 6042 - protein, 123 aa, Artificial Sequence
  Description of Artificial Sequence: Synthetic polypeptide
EVQLLESGGGLVQPGGSLRLSCAASGFTFVDYPMGWVRQAPGKGLEWVSTISTGGFSTYYADSVKGRFTISRDNSKNTLYLQMNSLRAEDTAVYYCAKARYYYLSQIKNFDYWGQGTLVTVSS

SEQ ID NO: 6043 - protein, 120 aa, Artificial Sequence
  Description of Artificial Sequence: Synthetic polypeptide
EVQLLESGGGLVQPGGSLRLSCAASGFTFDIYGMTWVRQAPGKGLEWVSSISPLGLVTYYADPVKGRFTISRDNSKNTLYLQMNSLRAEDTAVYYCAKLKEHGDVPFDYWGQGTLVTVSS

SEQ ID NO: 6044 - protein, 123 aa, Artificial Sequence
  Description of Artificial Sequence: Synthetic polypeptide
EVQLLESGGGLVQPGGSLRLSCAASGFTFELYPMSWVRQAPGKGLEWVSTISPTGLLTYYADSVKGRFTISRDNSKNTLYLQMNSLRAEDTAVYYCAKFKRSGKTDDTNFDYWGQGTLVTVSS

SEQ ID NO: 6045 - protein, 122 aa, Artificial Sequence
  Description of Artificial Sequence: Synthetic polypeptide
EVQLLESGGGLVQPGGSLRLSCAASGFTFSNYYMVWVRQAPGKGLEWVSAIDEWGFATYYADSVKGRFTISRDNSKNTLYLQMNSLRAEDTAVYYCAKHWEFTSDTSRFDYWGQGTLVTVSS

SEQ ID NO: 6046 - protein, 116 aa, Artificial Sequence
  Description of Artificial Sequence: Synthetic polypeptide
EVQLLESGGGLVQPGGSLRLSCAASGFTFREYDMLWVRQAPGKGLEWVSTIVGDGNGTYYADSVKGRFTISRDNSKNTLYLQMNSLRAEDTAVYYCAKQDRQFDYWGQGTLVTVSS

SEQ ID NO: 6047 - protein, 120 aa, Artificial Sequence
  Description of Artificial Sequence: Synthetic polypeptide
EVQLLESGGGLVQPGGSLRLSCAASGFTFEEYGMSWVRQAPGKGLEWVSTISPIGVTTYYADSVKGRFTISRDNSKNTLYLQMNSLRAEDTAVYYCAKNAYDRKSNFDYWGQGTLVTVSS

SEQ ID NO: 6048 - protein, 124 aa, Artificial Sequence
  Description of Artificial Sequence: Synthetic polypeptide
EVQLLESGGGLVQPGGSLRLSCAASGFTFDRYVMVWVRQAPGKDLEWVSGITPSGRRTYYADSVKGRFTISRDNSKDTLYLQMNSLRAEDTAVYYCAKVLGRHFDPLLPSFDYWGQGTLVTVSS

SEQ ID NO: 6049 - protein, 123 aa, Artificial Sequence
  Description of Artificial Sequence: Synthetic polypeptide
EVQLLESGGGLVQPGGSLRLSCAASGFTFEDYAMSWVRQAPGKGLEWVSTITPGGFWTYYADSVKGRFTISRDNSKNTLYLQMNSLRAEDTAVYYCAKTSSGELQLVEDFDYWGQGTLVTVSS

SEQ ID NO: 6050 - protein, 116 aa, Artificial Sequence
  Description of Artificial Sequence: Synthetic polypeptide
EVQLLESGGGLVQPGGSLRLSCAASGFTFEDFDMAWVRQAPGKGLEWVSSINDQGSLTYYADSVKGRFTISRDNSKNTLYLQMNSLRAEDTAVYYCAKPDQFFDYWGQGTLVTVSS

SEQ ID NO: 6051 - protein, 122 aa, Artificial Sequence
  Description of Artificial Sequence: Synthetic polypeptide
EVQLLESGGGLVQPGGSLRLSCAASGFTFSAYDMMWVRQAPGKGLEWVSRISPQGQRTYYADSVKGRFTISRDNSKNTLYLQMNSLRAEDTAVYYCAKIRGQSRIPMRFDYWGQGTLVTVSS

SEQ ID NO: 6052 - protein, 119 aa, Artificial Sequence
  Description of Artificial Sequence: Synthetic polypeptide
EVQLLESGGGLVQPGGSLRLSCAASGFTFPEYDMTWVRQAPGKGLEWVSYISSDGYSTYYADSVKGRFTISRDNSKNTLYLQMNSLRAEDTAVYYCAKPHGSPREFDYWGQGTLVTVSS

SEQ ID NO: 6053 - protein, 116 aa, Artificial Sequence
  Description of Artificial Sequence: Synthetic polypeptide
EVQLLESGGGLVQPGGSLRLSCAASGFTFTDYEMGWVRQAPGKGLEWVSTITSLGESTYYADSVKGRFTISRDNSKNTLYLQMNSLRAEDTAVYYCAKPGRIFDYWGQGTLVTVSS

SEQ ID NO: 6054 - protein, 123 aa, Artificial Sequence
  Description of Artificial Sequence: Synthetic polypeptide
EVQLLESGGGLVQPGGSLRLSCAASGFTFAFYPMMWVRQAPGKGLEWVSWIDATGTRTYYADSVKGRFTISRDNSKNTLYLQMNSLRAEDTAVYYCAEGNYGSSYTMGVFDYWGQGTLVTVSS

SEQ ID NO: 6055 - protein, 122 aa, Artificial Sequence
  Description of Artificial Sequence: Synthetic polypeptide
EVQLLESGGGLVQPGGSLRLSCAASGFTFDEYPMYWVRQAPGKGLEWVSSIGPSGPNTYYADSVKGRFTISRDNSKNTLYLQMNSLRAEDTAVYYCAKSPYFDVIPSYFDYWGQGTLVTVSS

SEQ ID NO: 6056 - protein, 119 aa, Artificial Sequence
  Description of Artificial Sequence: Synthetic polypeptide
EVQLLESGGGLVQPGGSLRLSCAASGFTFADYGMGWVRQAPGKGLEWVSSIQSSGLRTYYADSVKGRFTISRDNSKNTLYLQMNSLRAEDTAVYYCAKRANSRRGFDYWGQGTLVTVSS

SEQ ID NO: 6057 - protein, 116 aa, Artificial Sequence
  Description of Artificial Sequence: Synthetic polypeptide
EVQLLESGGGLVQPGGSLRLSCAASGFTFSDYEMMWVRQAPGKGLEWVSSITSHGGSTYYADSVKGRFTISRDNSKNTLYLQMNSLRAEDTAVYYCAKPDKDFDYWGQGTLVTVSS

SEQ ID NO: 6058 - protein, 122 aa, Artificial Sequence
  Description of Artificial Sequence: Synthetic polypeptide
EVQLLESGGGLVQPGGSLRLSCAASGFTFAHYPMSWVRQAPGKGLEWVSSIGRLGNRTYYADSVKGRFTISRDNSKNTLYLQMNSLRAEDTAVYYCAKRATPVPIKGLFDYWGQGTLVTVSS

SEQ ID NO: 6059 - protein, 116 aa, Artificial Sequence
  Description of Artificial Sequence: Synthetic polypeptide
EVQLLESGGGLVQPGGSLRLSCAASGLTFGRYEMAWVRQAPGKGLEWVSSIDSDGWVTYYADSVKGRFTISRDNSKNTLYLQMNSLRAEDTAVYYCAQPDSLFDYWGQGTLVTVSS

SEQ ID NO: 6060 - protein, 117 aa, Artificial Sequence
  Description of Artificial Sequence: Synthetic polypeptide
EVQLLESGGGLVQPGGSLRLSCAASGFTFSSYSMVWVRQAPGKGLEWVSGINRGGTRTYYADSVKGRFTISRDNSKNTLYLQMNSLRAEDTAVYYCAKGWRRGFDYWGQGTLVTVSS

SEQ ID NO: 6061 - protein, 117 aa, Artificial Sequence
  Description of Artificial Sequence: Synthetic polypeptide
EVQLLESGGGLVQPGGSLRLSCAASGFTFTRYRMSWVRQAPGKGLEWVSGISRDGYRTYYADSVKGRFTISRDNSKNTLYLQMNSLRAEDTAVYYCAKGMTASFDYWGQGTLVTVSS

SEQ ID NO: 6062 - protein, 118 aa, Artificial Sequence
  Description of Artificial Sequence: Synthetic polypeptide
EVQLLESGGGLVQPGGSLRLSCAASGFTFQMYPMGWVRQAPGKGLEWVSMIEPAGDLTYYADSVKGRFTISRDNSKNTLYLQMNSLRAEDTAVYYCAKYQEQPWFDYWGQGTLVTVSS

SEQ ID NO: 6063 - protein, 116 aa, Artificial Sequence
  Description of Artificial Sequence: Synthetic polypeptide
EVQLLESGGGLVQPGGSLRLSCAASGFPFPQYQMAWVRQAPGKGLEWVSMITSDGLDTYYADSVKGRFTISRDNSKNTLYLQMNSLRAEDTAVYYCAKPEPLFDYWGQGTLVTVSS

SEQ ID NO: 6064 - protein, 116 aa, Artificial Sequence
  Description of Artificial Sequence: Synthetic polypeptide
EVQLLESGGGLVQPGGSLRLSCAASGFTFSMYDMHWVRQAPGKGLEWVSTILSDGTDTYYADSVKGRFTISRDNSKNTLYLQMNSLRAEDTAVYYCAKYGAMFDYWGQGTLVTVSS

SEQ ID NO: 6065 - protein, 118 aa, Artificial Sequence
  Description of Artificial Sequence: Synthetic polypeptide
EVQLLESGGGLVQPGGSLRLSCAASGFTFKLYPMTWVRQAPGKGLEWVSSIDAGGHETYYADSVKGRFTISRDNSKNTLYLQMNSLRAEDTAVYYCAKDWWDYLFDYWGQGTLVTVSS

SEQ ID NO: 6066 - protein, 117 aa, Artificial Sequence
  Description of Artificial Sequence: Synthetic polypeptide
EVQLLESGGGLVQPGGSLRLSCAASGFTFSRYPMSWVRQAPGKGLEWVSSINRSGMRTYYADSVKGRFTISRDNSKNTLYLQMNSLRAEDTAVYYCAEGHQAPFDYWGQGTLVTVSS

SEQ ID NO: 6067 - protein, 123 aa, Artificial Sequence
  Description of Artificial Sequence: Synthetic polypeptide
EVQLLESGGGLVQPGGSLRLSCAASGFTFTGYAMSWVRQAPGKGLEWVSTINANGIRTYYADSVKGRFTISRDNSKNTLYLQMNGLRAEDTAVYYCAKGGVWRWGTGHKFDYWGQGTLVTVSS

SEQ ID NO: 6068 - protein, 118 aa, Artificial Sequence
  Description of Artificial Sequence: Synthetic polypeptide
EVQLLESGGGLVQPGGSLRLSCAASGFTFKQYDMRWVRQAPGKGLEWVSTISQNGTKTYYADSVKGRFTISRDNSKNTLYLQMNSLRAEDTAVYYCAKSRTGRYFDYWGQGTLVTVSS

SEQ ID NO: 6069 - protein, 123 aa, Artificial Sequence
  Description of Artificial Sequence: Synthetic polypeptide
EVQLLESGGGLVQPGGSLRLSCAASGFTFGTYDMGWVRQAPGKGLEWVSRINWQGDRTYYADSVKGRFTISRDNSKNTLYLQMNSLRAEDTAVYYCAKAGFGHYVDGLGFDYWGQGTLVTVSS

SEQ ID NO: 6070 - protein, 116 aa, Artificial Sequence
  Description of Artificial Sequence: Synthetic polypeptide
EVQLLESGGGLVQPGGSLRLSCAASGFTFSGYEMAWVRQAPGKGLEWVSSITDMGDSTYYADSVKGRFTISRDNSKNTLYLQMNSLRAEDTAVYYCAKPGTAFDYWGPGTLVTVSS

SEQ ID NO: 6071 - protein, 117 aa, Artificial Sequence
  Description of Artificial Sequence: Synthetic polypeptide
EVQLLESGGGLVQPGGSLRLSCAASGFTFAKYKMWWVRQAPGKGLEWVSSITPKGHSTYYADSVKGRFTISRDNSKNTLYLQMNSLRAEDTAVYYCAKRPMTPFDYWGQGTLVTVSS

SEQ ID NO: 6072 - protein, 122 aa, Artificial Sequence
  Description of Artificial Sequence: Synthetic polypeptide
EVQLLESGGGLVQPGGSLRLSCAASGFTFERYNMSWVRQAPGKGLEWVSSIRPRGGKTYYADSVKGRFTISRDNSKNTLYLQMNSLRAEDTAVYYCAKWRREGYTGSKFDYWGQGTLVTVSS

SEQ ID NO: 6073 - protein, 118 aa, Artificial Sequence
  Description of Artificial Sequence: Synthetic polypeptide
EVQLLESGGGLVQPGGSLRLSCAASGFTFERYGMTWVRQAPGKGLEWVSSIWPRGQKTYYADSVKGRFTISRDNSKNTLYLQMNSLRAEDTAVYYCAKGNSRYVFDYWGQGTLVTVSS

SEQ ID NO: 6074 - protein, 116 aa, Artificial Sequence
  Description of Artificial Sequence: Synthetic polypeptide
EVQLLESGGGLVQPGGSLRLSCAASGFTFSDYEMMWVRQAPGKGLEWVSTITSDGISTYYADSVKGRFTIFRDNSKNTLYLQMNSLRAEDTAVYYCAKSGRFFDYWGQGTLVTVSS

SEQ ID NO: 6075 - protein, 116 aa, Artificial Sequence
  Description of Artificial Sequence: Synthetic polypeptide
EVQLLESGGGLVQPGGSLRLSCAASGFTFSGYQMAWVRQAPGKGLEWVSGISSEGLTTYYADSVKGRFTISRDNSKNTLYLQMNSLRAEDTAVYYCAKLGRRFDYWGQGTLVTVSS

SEQ ID NO: 6076 - protein, 120 aa, Artificial Sequence
  Description of Artificial Sequence: Synthetic polypeptide
EVQLLESGGGLVQPGGSLRLSCAASGFTFTNYSMGWVRQAPGKGLEWVSTIRPNGTKTYYADSVKGRFTISRDNSKNTLYLQMNSLRAEDTAVYYCAKRSSAHLQRFDYWGQGTLVTVSS

SEQ ID NO: 6077 - protein, 119 aa, Artificial Sequence
  Description of Artificial Sequence: Synthetic polypeptide
EVQLLESGGGLVQPGGSLRLSCAASGFTFGNYSMGWVRQAPGKGLEWVSSIGRHGGRTYYADSVKGRFTISRDNSKNTLYLQMNSLRAEDTAVYYCAKKGSTYPRFDYWGQGTLVTVSS

SEQ ID NO: 6078 - protein, 118 aa, Artificial Sequence
  Description of Artificial Sequence: Synthetic polypeptide
EVQLLESGGGLVQPGGSLRLSCTASGFTFSHYEMGWVRQAPGKGLEWVSSIEPFGGGTYYADSVKGRFTISRDNSKNTLYLQMNSLRAEDTAVYYCAKVYPQGSFDYWGQGTLVTVSS

SEQ ID NO: 6079 - protein, 124 aa, Artificial Sequence
  Description of Artificial Sequence: Synthetic polypeptide
EVQLLESGGGLVQPGGSLRLSCAASGFTFSNYTMGWVRQAPGKGLEWVSSIRPDGKITYYADSVKGRFTISRDNSKNTLYLQMNSLRAEDTAVYYCAEVYSSCAMCTPLLFDYWGQGTLVTVSS

SEQ ID NO: 6080 - protein, 123 aa, Artificial Sequence
  Description of Artificial Sequence: Synthetic polypeptide
EVQLLESGGGLVQPGGSLRLSCAASGFTFKRYSMAWVRQAPGKGLEWVSDIGPRGFSTYYADSVKGRFTISRDNSKNTLYLQMNSLRAEDTAVYYCAKVGRGQRDTSQPFDYWGQGTLVTVSS

SEQ ID NO: 6081 - protein, 116 aa, Artificial Sequence
  Description of Artificial Sequence: Synthetic polypeptide
EVQLLESGGGLVQPGGSLRLSCAASGFTFASYQMAWVRQAPGKGLEWVSGITSGGLSTYYADSVKGRFTISRDNSKNTLYLQMNSLRAEDTAVYYCAKPGRGFDYWGQGTLVTVSS

SEQ ID NO: 6082 - protein, 116 aa, Artificial Sequence
  Description of Artificial Sequence: Synthetic polypeptide
EVQLLESGGGLVQPGGSLRLSCAASGFTFASYEMTWVRQAPGKGLEWVSGISSDGLSTYYADSVKGRFTISRDNSKNTLYLQMNSLRAEDTAVYYCAKPGVLFDYWGQGTLVTVSS

SEQ ID NO: 6083 - protein, 117 aa, Artificial Sequence
  Description of Artificial Sequence: Synthetic polypeptide
EVQLLESGGGLVQPGGSLRLSCAASGFTFDKYLMSWVRQAPGKGLEWVSGIEPLGDVTYYADSVKGRFTISRDNSKNTLYLQMNSLRAEDTAVYYCAKEASGDFDYWGQGTLVTVSS

SEQ ID NO: 6084 - protein, 116 aa, Artificial Sequence
  Description of Artificial Sequence: Synthetic polypeptide
EVQLLESGGGLVQPGGSLRLSCAASGFTFTEYEMSWVRQAPGKGLEWVSSIDNVGSSTYYADSVKGRFTISRDNSKNTLYLQMNSLRAEDTAVYYCAKPGKLFDYWGQGTLVTVSS

SEQ ID NO: 6085 - protein, 118 aa, Artificial Sequence
  Description of Artificial Sequence: Synthetic polypeptide
EVQLLESGGGLVQPGGSLRLSCAASGFTFADYEMWWVRQAPGKGLEWVSAISRQGFATYYADSVKGRFTISRDNSKNTLYLQMNSLRAEDTAVYYCAKDLERDDFDYWGQGTLVTVSS

SEQ ID NO: 6086 - protein, 120 aa, Artificial Sequence
  Description of Artificial Sequence: Synthetic polypeptide
EVQLLESGGGLVQPGGSLRLSCAASGFTFANYEMGWARQAPGKGLEWVSVISEWGYSTYYADSAKGRFTISRDNSKNTLYLQMNSLRAEDTAVYYCAKLVGGTQYEFDYWGQGTLVTVSS

SEQ ID NO: 6087 - protein, 116 aa, Artificial Sequence
  Description of Artificial Sequence: Synthetic polypeptide
EVQLLESGGGLVQPGGSLRLSCAASGFTFHNYEMSWVRQAPGKGLEWVSSISSGGSSTYYADSVKGRFTISRDNSKNTLYLQMNSLRAEDTAVYYCAKPGVKFDYWGQGTLVTVSS

SEQ ID NO: 6088 - protein, 116 aa, Artificial Sequence
  Description of Artificial Sequence: Synthetic polypeptide
EVQLLESGGGLVQPGGSLRLSCAASGFTFGLYEMTWVRQAPGKGLEWVSSITGDGISTYYADSVKGRFTISRDNSRNTLYLQMNSLRAEDTAVYYCAKAGRKFDYWGQGTLVTVSS

SEQ ID NO: 6089 - protein, 116 aa, Artificial Sequence
  Description of Artificial Sequence: Synthetic polypeptide
EVQLLESGGGLVQPGGSLRLSCAASGFTFSNYQMAWVRQAPGKGLEWVSSITSEGGSTYYADSVKGRFTISRDNSKNTLYLQMNSLRAEDTAVYYCAKPGKNFDYWGQGTLVTVSS

SEQ ID NO: 6090 - protein, 116 aa, Artificial Sequence
  Description of Artificial Sequence: Synthetic polypeptide
EVQLLESGGGLVQPGGSLRLSCAASGFTFSDYQMAWVRQAPGKGLEWVSSITSEGGSTYYADSVKGRFTISRDNSKNTVYLQMNSLRAEDTAVYYCAKPGKNFDYWGQGTLVTVSS

SEQ ID NO: 6091 - protein, 116 aa, Artificial Sequence
  Description of Artificial Sequence: Synthetic polypeptide
EVQLLESGGGLVQPGGSLRLSCAASGFTFDNYEMTWVRQAPGKGLEWVSTITSQGTSTYYADSVKGRFTISRDNSKNTLYLQMNSLRAEDTAVYYCAKPDRSFDYWGQGTLVTVSS

SEQ ID NO: 6092 - protein, 116 aa, Artificial Sequence
  Description of Artificial Sequence: Synthetic polypeptide
EVQLLESGGGLVQPGGSLRLSCAASGFTFRSYEMTWVRQAPGKGLEWVSSITSDGGTTYYADSVKGRFTISRDNSKNTLYLQMNSLRAEDTAVYYCAKPDKTFDYWGQGTLVTVSS

SEQ ID NO: 6093 - protein, 116 aa, Artificial Sequence
  Description of Artificial Sequence: Synthetic polypeptide
EVQLLESGGGLVQPGGSLRLSCAASGFTFNLYEMTWVRQAPGKGLEWVSSITSDGVSTYYADSVKGRFTISRDNSKNTLYLQMNSLRAEDTAVYYCAKPDSPFDYWGQGTLVTVSS

SEQ ID NO: 6094 - protein, 116 aa, Artificial Sequence
  Description of Artificial Sequence: Synthetic polypeptide
EVQLLESGGGLVQPGGSLRLSCAASGFTFGHYDMAWVRQAPGKGLEWVSTISDNGNGTYYADSVKGRFTISRDNSKNTLYLQMNSLRAEDTAVYYCAKPGRDFDYWGQGTLVTVSS

SEQ ID NO: 6095 - protein, 116 aa, Artificial Sequence
  Description of Artificial Sequence: Synthetic polypeptide
EVQLLESGGGLVQPGGSLRLSCAASGFTFGRYQMAWVRQAPGKGLEWVSSISSDGGGTYYADSVKGRFTISRDNSKNTLYLQMNSLRAEDTAVYYCAKPGRAFDYWGQGTLVTVSS

SEQ ID NO: 6096 - protein, 116 aa, Artificial Sequence
  Description of Artificial Sequence: Synthetic polypeptide
EVQLLESGGGLVQPGGSLRLSCAASGFTFARYQMAWVRQAPGKGLEWVSTISDDGDSTYYADSVKGRFTISRDNSKNTLYLQMNSLRAEDTAVYYCAKLDKLFDYWGQGTLVTVSS

SEQ ID NO: 6097 - protein, 116 aa, Artificial Sequence
  Description of Artificial Sequence: Synthetic polypeptide
EVQLLESGGGLVQPGGSLRLSCAASGFTFDNDEMTWVRQAPGKGLEWVSAIDTTGGQTYYADSVKGRFTISRDNSKNTLYLQMNSLRAEDTAVYYCAKPGKEFDYWGQGTLVTVSS

SEQ ID NO: 6098 - protein, 116 aa, Artificial Sequence
  Description of Artificial Sequence: Synthetic polypeptide
EVQLLESGGGLVQPGGSLRLSCAASGFTFGESEMSWVRQAPGKGLEWVSSILDEGSGTYYADSVKGRFTISRDNSKNTLYLQMNSLRAEDTAVYYCAKPDKDFDYWGQGTLVTVSS

SEQ ID NO: 6099 - protein, 117 aa, Artificial Sequence
  Description of Artificial Sequence: Synthetic polypeptide
EVQLLESGGGLVQPGGSLRLSCAASGFTFGEEEMSWVRQAPGKGLEWVSAITDDGDDTYYADSVKGRFTISRDNSKNTLYLQMNSLRAEDTAVYYCAKPNAGAFDYWGQGTLVTVSS

SEQ ID NO: 6100 - protein, 116 aa, Artificial Sequence
  Description of Artificial Sequence: Synthetic polypeptide
EVQLLESGGGLVQPGGSLRLSCAASGFTFEVYDMAWVRQAPGKGLEWVSGIVNDGSSTYYADSVKGRFTISRDNSKNTLYLQMNSLRAEDTAVYYCAKPDKDFDYWGQGTLVTVSS

SEQ ID NO: 6101 - protein, 116 aa, Artificial Sequence
  Description of Artificial Sequence: Synthetic polypeptide
EVQLLESGGGLVQPGGSLRLSCAASGFTFGNTEMTWVRQAPGKGLEWVSSIADDGSSTYYADSVKGRFTISRDNSKNTLYLQMNSLRAEDTAVYYCAKPGQAFDYWGQGTLVTVSS

SEQ ID NO: 6102 - protein, 116 aa, Artificial Sequence
  Description of Artificial Sequence: Synthetic polypeptide
EVQLLESGGGLVQPGGSLRLSCAASGFTFEEYQMAWVRQAPGKGLEWVSTISDDGSSTYYADSVKGRFTISRDNSKNTLYLQMNSLRAEDTAVYYCAKPDLYFDYWGQGTLVTVSS

SEQ ID NO: 6103 - protein, 116 aa, Artificial Sequence
  Description of Artificial Sequence: Synthetic polypeptide
EVQLLESGGGLVQPGGSLRLSCAASGFTFEVYQMGWVRQAPGKGLEWVSFIVPGGDLTYYADSVKGRFTISRDNSKNTLYLQMNSLRAEDTAVYYCAETWPEFDYWGQGTLVTVSS

SEQ ID NO: 6104 - protein, 116 aa, Artificial Sequence
  Description of Artificial Sequence: Synthetic polypeptide
EVQLLESGGGLVQPGGSLRLSCAASGFTFDNYEMTWVRQAPGKGLEWVSSITSDGTSTYYADSVKGRFTISRDNSKNTLYLQMNSLRAEDTAVYYCAKPNPPFDYWGQGTLVTVSS

SEQ ID NO: 6105 - protein, 119 aa, Artificial Sequence
  Description of Artificial Sequence: Synthetic polypeptide
EVQLLESGGGLVQPGGSLRLSCAASGFTFKAYDMGWVRQAPGKGLEWVSQIGRDGSFTYYADSVKGRFTISRDNSKNTLYLQMNSLRAEDTAVYYCAKPRRYAIFTFDRGQGTLVTVSS

SEQ ID NO: 6106 - protein, 121 aa, Artificial Sequence
  Description of Artificial Sequence: Synthetic polypeptide
EVQLLESGGGLVQPGGSLRLSCAASGFTFKQYPMVWVRQAPGKGLEWVSTISTNGVRTYYADSVKGRFTISRDNSKNTLYLQMNSLRAEDTAVYYCAKWTDIISSSEFDYWGQGTLVTVSS

SEQ ID NO: 6107 - protein, 123 aa, Artificial Sequence
  Description of Artificial Sequence: Synthetic polypeptide
EVQLLESGGGLVQPGGSLRLSCAASGFTFFNYDMSWVRQAPGKGLEWVSAISGSGGSTYYADSVKGRFTISRDNSKNTLYLQMNSLRAEDTAVYYCAKVFVWSADIDFDFDYWGQGTLVTVSS

SEQ ID NO: 6108 - protein, 123 aa, Artificial Sequence
  Description of Artificial Sequence: Synthetic polypeptide
EVQLLESGGGLVQPGGSLRLSCAASGFTFSWYDMSWVRQAPGKGLEWVSHIASWGGKTYYADSVKGRFTISRDNSKNTLYLQMNSLRAEDTAVYYCAKVTVKDGGYLMDFDYWGQGTLVTVSS

SEQ ID NO: 6109 - protein, 122 aa, Artificial Sequence
  Description of Artificial Sequence: Synthetic polypeptide
EVQLLESGGGLVQPGGSLRLSCAASGFTFAEYAMAWVRQAPGKGLEWVSSIGRDGAVTYYADSVKGRFTISRDNSKNTLYLQMNSLRAEDTAVYYCAKWKAAKERGSWFDYWGQGTLVTVSS

SEQ ID NO: 6110 - protein, 116 aa, Artificial Sequence
  Description of Artificial Sequence: Synthetic polypeptide
EVQLLESGGGLVQPGGSLRLSCAASGFTFQAYQMQWVRQAPGKGLEWVSTISPNGLFTYYADSVKGRFTISRDNSKNTLYLQMNSLRAEDTAVYYCAKWLSSFDYWGQGTLVTVSS

SEQ ID NO: 6111 - protein, 120 aa, Artificial Sequence
  Description of Artificial Sequence: Synthetic polypeptide
EVQLLESGGGLVQPGGSLRLSCAASGFTFAMYSMAWVRQAPGKGLEWVSGISPRGVETYYADSVKGRFTISRDNSKNTLYLQMNSLRAEDTAVYYCAKTNWNGVDLFDYWGQGTLVTVSS

SEQ ID NO: 6112 - protein, 119 aa, Artificial Sequence
  Description of Artificial Sequence: Synthetic polypeptide
EVQLLESGGGLVQPGGSLRLSCAASGFTFPTYMMSWVRQAPGKGLEWVSTINTNGRDTYYADSVKGRFTISRDNSKNTLYLQMNSLRAEDTAVYYCAKGDSNMSFFDYWGQGTLVTVSS

SEQ ID NO: 6113 - protein, 120 aa, Artificial Sequence
  Description of Artificial Sequence: Synthetic polypeptide
EVQLLESGGGLVQPGGSLRLSCAASGFTFEGYSMTWVRQAPGKGLEWVSSINASGTLTYYADSVKGRFTISRDNSKNTLYLQMNSLRAEDTAVYYCAKDGNRSEVFFDYWGQGTLVTVSS

SEQ ID NO: 6114 - protein, 116 aa, Artificial Sequence
  Description of Artificial Sequence: Synthetic polypeptide
EVQLLESGGGLVQPGGSLRLSCAASGFTFFEYEMTWVRQAPGKGLEWVSSIANDGSTTYYADSVKGRFTISRDNSKNTLYLQMNSLRAEDTAVYYCAKPDRQFDYWGQGTLVTVSS

SEQ ID NO: 6115 - protein, 116 aa, Artificial Sequence
  Description of Artificial Sequence: Synthetic polypeptide
EVQLLESGGGLVQPGGSLRLSCAASGFTFQDYLMAWVRQAPGKGLEWVSEINQDGTVTYYADSVKGRFTISRDNSKNTLYLQMNSLRAEDTAVYYCAESSPYFDYWGQGTLVTVSS

SEQ ID NO: 6116 - protein, 123 aa, Artificial Sequence
  Description of Artificial Sequence: Synthetic polypeptide
EVQLLESGGGLVQPGGSLRLSCAASGFTFDNYAMSWVRQAPGKGLEWVSSISRDGHVTYYADSVKGRFTISRDNSKNTLYLQMNSLRAEDTAVYYCAKLSSKGGTFASSFDYWGQGTLVTVSS

SEQ ID NO: 6117 - protein, 119 aa, Artificial Sequence
  Description of Artificial Sequence: Synthetic polypeptide
EVQLLESGGGLVQPGGSLRLSCAASGFTFSAVPMTWVRQAPGKGLEWVSAITDDGLRTYYADSVKGRFTISRDNSKNTLYLQMNSLRAEDTAVYYCAKGHIYGDYFDYWGQGTLVTVSS

SEQ ID NO: 6118 - protein, 123 aa, Artificial Sequence
  Description of Artificial Sequence: Synthetic polypeptide
EVQLLESGGGLVQPGGSLRLSCAASGFTFELYRMMWVRQAPGKGLEWVSAISSDGDTTYYADSVKGRFTISRDNSKNTLYLQMNSLRAEDTAVYYCAEHWLGTTLSLRDFDYWGQGTLVTVSS

SEQ ID NO: 6119 - protein, 123 aa, Artificial Sequence
  Description of Artificial Sequence: Synthetic polypeptide
EVQLLESGGGLVQPGGSLRLSCAASGFTFYRYTMAWVRQAPGKGLEWVSQISPRGNITYYADSVKGRFTISRDNSKNTLYLQMNSLRAEDTAVYYCAKSGVAGAESPEYFDYWGQGTLVTVSS

SEQ ID NO: 6120 - protein, 119 aa, Artificial Sequence
  Description of Artificial Sequence: Synthetic polypeptide
EVQLLESGGGLVQPGGSLRLSCAASGFTFLGYYMSWIRQAPGKGLEWVSTIGPIGGGTYYADSVKGRFTISRDNSKNTLYLQMNSLRAEDTAVYYCAKSQNIYGPFDYWGQGTLVTVSS

SEQ ID NO: 6121 - protein, 116 aa, Artificial Sequence
  Description of Artificial Sequence: Synthetic polypeptide
EVQLLESGGGLVQPGGSLRLSCAASGFTFEQYDMAWVRQAPGKGLEWVSEISRDGGRTYYADSVKGRFTISRDNSKNTLYLQMNSLRAEDTAVYYCAEEYPYFDYWGQGTLVTVSS

SEQ ID NO: 6122 - protein, 121 aa, Artificial Sequence
  Description of Artificial Sequence: Synthetic polypeptide
EVQLLESGGGLVQPGGSLRLSCAASGFTFPQYSMVWVRQAPGKGLEWVSTISPLGSSTYYADSVKGRFTISRDNSKNTLYLQMNSLRAEDTAVYYCAKMSKLLLSREFDYWGQGTLVTVSS

SEQ ID NO: 6123 - protein, 120 aa, Artificial Sequence; identical to SEQ ID NO: 6111
  Description of Artificial Sequence: Synthetic polypeptide

SEQ ID NO: 6124 - protein, 119 aa, Artificial Sequence
  Description of Artificial Sequence: Synthetic polypeptide
EVQLLESGGGLVQPGGSLRLSCAASGFTFTRHGMAWVRQAPGKGLEWVSTITPTGNTTYYADSVKGRFTISRDNSKNTLYLQMNSLRAEDTAVYYCAKDAHDEGYFDYWGQGTLVTVSS

SEQ ID NO: 6125 - protein, 116 aa, Artificial Sequence
  Description of Artificial Sequence: Synthetic polypeptide
EVQLLESGGGLVQPGGSLRLSCAASGFTFGPYEMTWVRQAPGKGLEWVSSIVGDGLDTYYADSVKGRFTISRDNSKNTLYLQMNSLRAEDTAVYYCAKPDRVFDYWGQGTLVTVSS

SEQ ID NO: 6126 - protein, 114 aa, Artificial Sequence
  Description of Artificial Sequence: Synthetic polypeptide
EVQLLESGGGLVQPGGSLRLSCAASGFTFGSTPMMWVRQAPGKGLEWVSEIRDTGLATYYADSVKGRFTISRDNSKNTLYLQMNSLRAEDTAVYYCASVSFDYWGQGTLVTVSS

SEQ ID NO: 6127 - protein, 118 aa, Artificial Sequence
  Description of Artificial Sequence: Synthetic polypeptide
EVQLLESGGGLVQPGGSLRLSCAASGFTFHLGDMHWVRQAPGKGLEWVSSISGTGHTTYYADSVKGRFTISRDNSKNTLYLQMNSLRAEDTAVYYCAKPMNDQGFDYWGQGTLVTVSS

SEQ ID NO: 6128 - protein, 116 aa, Artificial Sequence
  Description of Artificial Sequence: Synthetic polypeptide
EVQLLESGGGLVQPGGSLRLSCAASGFTFMDEDMLWVRQAPGKGLEWVSRINSLGTHTYYADSVKGRFTISRDNSKNTLYLQMNSLRAEDTAVYYCAKSFMMFDYWGQGTLVTVSS

SEQ ID NO: 6129 - protein, 116 aa, Artificial Sequence
  Description of Artificial Sequence: Synthetic polypeptide
EVQLLESGGGLVQPGGSLRLSCAASGFTFRNYQMHWVRQAPGKGLEWVSGIDATGRATYYADSVKGRFTISRDNSKNTLYLQMNSLRAEDTAVYYCARSTRSFDYWGQGTLVTVSS

SEQ ID NO: 6130 - protein, 118 aa, Artificial Sequence
  Description of Artificial Sequence: Synthetic polypeptide
EVQLLESGGGLVQPGGSLRLSCAASGFTFTNADMVWVRQAPGKGLEWVSSISGSGGSTYYADSVKGRFTISRDNSKNTLYLQMNSLRAEDTAVYYCAKGYLTSHFDYWGQGTLVTVSS

SEQ ID NO: 6131 - protein, 120 aa, Artificial Sequence
  Description of Artificial Sequence: Synthetic polypeptide
EVQLLESGGGLVQPGGSLRLSCAASGFTFRDYSMAWVRQAPGKGLEWVSTITPSGLTTYYADSVKGRFTISRDNSKNTLYLQMNSLRAEDTAVYYCAEWSQAVTRSFDYWGQGTLVTVSS

SEQ ID NO: 6132 - protein, 116 aa, Artificial Sequence
  Description of Artificial Sequence: Synthetic polypeptide
EVQLLESGGDLVQPGGSLRLSCAASGFTFSDEGMMWVRQAPGKGLEWVSEINQQGSATYYADSVKGRFTISRDNSKNTLYLQMNSLRAEDTAVYYCAKTIGMFDYWGQGTLVTVSS

SEQ ID NO: 6133 - protein, 123 aa, Artificial Sequence
  Description of Artificial Sequence: Synthetic polypeptide
EVQLLESGGGLVQPGGSLRLSCAASGFTFTDQPMVWVRQAPGKGLEWVSSIGARGGPTYYADSVKGRFTVSRDNSKNTLYLQMNSLRAEDTAVYYCAKWFDIIAWDPFSFDYWGQGTLVTVSS

SEQ ID NO: 6134 - protein, 119 aa, Artificial Sequence
  Description of Artificial Sequence: Synthetic polypeptide
EVQLLESGGGLVQPGGSLRLSCAASGFTFNQYPMMWVRQAPGKGLEWVSSITPSGFLTYYADSVKGRFTISRDNSKNTLYLQMNSLRAEDTAVYYCAEWNPFITTFDYWGQGTLVTVSS

SEQ ID NO: 6135 - protein, 118 aa, Artificial Sequence
  Description of Artificial Sequence: Synthetic polypeptide
EVQLLESGGGLVQPGGSLRLSCAASGFTFGHQQMAWVRQAPGKGLEWVSTITPNGYYTYYADSVKGRFTISRDNSKNTLYLQMNSLRAEDTAVYYCAKFDYSLRFDYWGQGTLVTVSS

SEQ ID NO: 6136 - protein, 116 aa, Artificial Sequence
  Description of Artificial Sequence: Synthetic polypeptide
EVQLLESGGGLVQPGGSLRLSCAASGFTFASYEMAWVRQAPGKGLEWVSSIGSDGGPTYYADSVKGRFTISRDNSKNTLYLQMNSLRAEDSAVYYCAKPDRAFDYWGQGTLVTVSS

SEQ ID NO: 6137 - protein, 124 aa, Artificial Sequence
  Description of Artificial Sequence: Synthetic polypeptide
EVQLLESGGGLVQPGGSLRLSCAASGFTFSAEQMTWARQAPGKGLEWVSTITPHGDSTYYADSVKGRFTISRDNSKNTLYLQMNSLRAEDTAVYYCAKWRTLVDWPTSESFDYWGQGTLVTVSS

SEQ ID NO: 6138 - protein, 119 aa, Artificial Sequence
  Description of Artificial Sequence: Synthetic polypeptide
EVQLLESGGGLVQPGGSLRLSCAASGFTFTSYEMGWVRQAPGKGLEWVSSIEPTGITTYYADSVKGRFTISRDNSKNTLYLQMNSLRAEDTAVYYCAKPHFTELGFDYWGQGTLVTVSS

SEQ ID NO: 6139 - protein, 117 aa, Artificial Sequence
  Description of Artificial Sequence: Synthetic polypeptide
EVQLLESGGGLVQPGGSLRLSCAASGFTFEGEQMAWVRQAPGKGLEWVSTITLPGPYTFYADSVKGRFTISRDNSKNTLYLQMNSLRAEDTAVYYCAKGNGTFFDYWGQGTLVTVSS

SEQ ID NO: 6140 - protein, 120 aa, Artificial Sequence
  Description of Artificial Sequence: Synthetic polypeptide
EVQLLESGGGLVQPGGSLRLSCAASGFTFGNYAMAWVRQAPGKGLEWVSKIGAQGLHTYYAGSVKGRFTISRDNSKNTLYLQMNSLRAEDTAVYYCAKQTTMDYERFDYWGQGTLVTVSS

SEQ ID NO: 6141 - protein, 121 aa, Artificial Sequence
  Description of Artificial Sequence: Synthetic polypeptide
EVQLLESGGGLVQPGGSLRLSCAASGFTFDEVDMSWVRQAPGKGLEWVSAIGNNGLKTYYADSVKGRFTISRDNSKNTLYLQMNSLRAEDTAVYYCAKSALSYRPPVFDYWGQGTLVTVSS

SEQ ID NO: 6142 - protein, 118 aa, Artificial Sequence
  Description of Artificial Sequence: Synthetic polypeptide
EVQLLESGGGLVQPGGSLRLSCAASGFTFQDDTMSWVRQAPGKGLEWVSTITLKGPSTYYADSVKGRFTISRDNSKNTLYLQMNSLRAEDTAVYYCAKSRDGLYFDYWGQGTLVTVSS

SEQ ID NO: 6143 - protein, 118 aa, Artificial Sequence
  Description of Artificial Sequence: Synthetic polypeptide
EVQLLESGGGLVQPGGSLRLSCAASGFTFASSPMAWVRQAPGKGLEWVSSIGRDGSTTYYADSVKGRFTISRDNSKNTLYLQMNSLRAEDTAVYYCAKPSPYRRFDYWGQGTLVTVSS

SEQ ID NO: 6144 - protein, 120 aa, Artificial Sequence
  Description of Artificial Sequence: Synthetic polypeptide
EVQLLESGGGLVQPGGSLRLSCAASGFTFTDYSMVWVRQAPGKGLEWVSTIVSHGGTTYYADSVKGRFTISRDNSKNTLYLQMNSLRAEDTAVYYCAKGKGYNAQYFDYWGQGTLVTVSS

SEQ ID NO: 6145 - protein, 118 aa, Artificial Sequence; identical to SEQ ID NO: 6135
  Description of Artificial Sequence: Synthetic polypeptide

SEQ ID NO: 6146 - protein, 116 aa, Artificial Sequence
  Description of Artificial Sequence: Synthetic polypeptide
EVQLLESGGGLVQPGGSLRLSCAASGFTFNDYDMIWVRQAPGKGLEWVSTISSHGDSTYYADSVKGRFTISRDNSKNTLYLQMNSLRAEDTAVYYCAKGDVFFDYWGQGTLVTVSS

SEQ ID NO: 6147 - protein, 116 aa, Artificial Sequence
  Description of Artificial Sequence: Synthetic polypeptide
EVQLLESGGGLVQPGGSLRLSCAASGFTFGHQQMAWVRQAPGKGLEWVSTITPNGYYTYYADSVKGRFTISRDNSKNTLYLQMNSLRAEDTAVYYCAEWSDSFDYRGQGTLVTVSS

SEQ ID NO: 6148 - protein, 119 aa, Artificial Sequence
  Description of Artificial Sequence: Synthetic polypeptide
EVQLLESGGGLVQPGGSLRLSCAASGFTFADYEMAWVRQAPGKGLEWVSGIQSNGNITYYADSVKGRFTISRDNSKNTLYLQMNSLRAEDTAVYYCAKANSQVEYFDYWGQGTLVTVSS

SEQ ID NO: 6149 - protein, 118 aa, Artificial Sequence
  Description of Artificial Sequence: Synthetic polypeptide
EVQLLESGGGLVQPGGSLRLSCAASGFTFGVEPMSWVRQAPGKGLEWVSNIGRDGSMTYYADSVKGRFTISRDNSKNTLYLQMNSLRAEDTAVYYCAKLGKHGTFDYWGQGTLVTVSS

SEQ ID NO: 6150 - protein, 119 aa, Artificial Sequence
  Description of Artificial Sequence: Synthetic polypeptide
EVQLLESGGGLVQPGGSLRLSCAASGFTFPEYRMMWVRQAPGKGLEWVSWIDERGSLTYYADSVKGRFTISRDNSKNTLYLQMNSLRAEDTAVYYCAKRRKGTKQFDYWGQGTLVTVSS

SEQ ID NO: 6151 - protein, 117 aa, Artificial Sequence
  Description of Artificial Sequence: Synthetic polypeptide
EVQLLESGGGLVQPGGSLRLSCAASGFTFIAYDMSWVRQAPGKGLEWVSWIDEWGLQTYYADSVKGRFTISRDNSKNTLYLQMNSLRAEDTAVYYCAKKTPEEFDYWGQGTLVTVSS

SEQ ID NO: 6152 - protein, 122 aa, Artificial Sequence
  Description of Artificial Sequence: Synthetic polypeptide
EVQLLESGGGLVQPGGSLRLSCAASGFTFELYAMAWVRQAPGKGLEWVSGIGAVGETTYYADSVKGRFTISRDNSKNTLYLQMNSLRAEDTAVYYCAKEANNLSDNLVFDYWGQGTLVTVSS

SEQ ID NO: 6153 - protein, 117 aa, Artificial Sequence
  Description of Artificial Sequence: Synthetic polypeptide
EVQLLESGGGLVQPGGSLRLSCAASGFTFGHQQMAWVRQAPGKGLEWVSTITPNGYYTYYADSVKGRFTISRDNSKNTLYLQMNSLRAEDTAVYYCAKWSVEWFDYWGQGTLVTVSS

SEQ ID NO: 6154 - protein, 116 aa, Artificial Sequence
  Description of Artificial Sequence: Synthetic polypeptide
EVQLLESGGGLVQPGGSLRLSCAASGFTFNSYTMNWVRQAPGKGLEWVSSINPWGSRTYYADSVKGRFTISRDNSKNTLYLQMNSLRAEDTAVYYCAKGLVLFDYWGQGTLVTVSS

SEQ ID NO: 6155 - protein, 119 aa, Artificial Sequence
  Description of Artificial Sequence: Synthetic polypeptide
EVQLLESGGGLVQPGGSLRLSCAASGFTFDGDMMSWVRQAPGKGLEWVSSITQLGSRTYYADSVKGRFTISRDNSKNTLYLQMNSLRAEDTAVYYCAKQNWRTLTFDYWGQGTLVTVSS

SEQ ID NO: 6156 - protein, 119 aa, Artificial Sequence
  Description of Artificial Sequence: Synthetic polypeptide
EVQLLESGGGLVQPGGSLRLSCAASGFTFNAYGMMWVRQAPGKGLEWVSSILSDGVITYYADSVKGRFTISRDNSKNTLYLQMNSLRAEDTAVYYCAKSARGANFFDYWGQGTLVTVSS

SEQ ID NO: 6157 - protein, 120 aa, Artificial Sequence
  Description of Artificial Sequence: Synthetic polypeptide
EVQLLESGGGLVQPGGSLRLSCAASGFTFGHYMMVWVRQAPGKGLEWVSSITPHGTSTYYADSVKGRFTISRDNSKNTLYLQMNSLRAEDTAVYYCAEFNAIFSEAFDYWGQGTLVTVSS

SEQ ID NO: 6158 - protein, 120 aa, Artificial Sequence; identical to SEQ ID NO: 6131
  Description of Artificial Sequence: Synthetic polypeptide

SEQ ID NO: 6159 - protein, 120 aa, Artificial Sequence
  Description of Artificial Sequence: Synthetic polypeptide
EVQLLESGGGLVQPGGSLRLSCAASGFTFDLYAMAWVRQAPGKGLEWVSMIGRDGRFTYYADSVKGRFTISRDNSKNTLYLQMNSLRAEDTAVYYCAKLAGSLRGRFDYWGQGTLVTVSS

SEQ ID NO: 6160 - protein, 118 aa, Artificial Sequence
  Description of Artificial Sequence: Synthetic polypeptide
EVQLLESGGGLVQPGGSLRLSCAASGFTFNKASMGWVRQAPGKGLEWVSTITPHGSSTYYADSVKGRFTISRDNSKNTLYLQMNSLRAEDTAVYYCAKQRWGVEFDYWGQGTLVTVSS

SEQ ID NO: 6161 - protein, 120 aa, Artificial Sequence
  Description of Artificial Sequence: Synthetic polypeptide
EVQLLESGGGLVQPGGSLRLSCAASGFTFQGYSMGWVRQAPGKGLEWVSSIAGRGGVTYYADSVKGRFTISRDNSKNTLYLQMNSLRAEDTAVYYCAKGLYIYHSLFDYWGQGTLVTVSS

SEQ ID NO: 6162 - protein, 116 aa, Artificial Sequence
  Description of Artificial Sequence: Synthetic polypeptide
EVQLLESGGGLVQPGGSLRLSCAASGFTFGDYEMSWVRQAPGKGLEWVSGIDGEGSDTYYADSVKGRFTISRDNSKNTLYLQMNSLRAEDTAVYYCAKPGRSFDYWGQGTLVTVSS

SEQ ID NO: 6163 - protein, 116 aa, Artificial Sequence
  Description of Artificial Sequence: Synthetic polypeptide
EVQLLESGGGLVQPGGSLRLSCAASGFTFPGMEMSWVRQAPGKGLEWVSAITGTGSTTYYADSVKGRFTISRDNSKNTLYLQMNSLRAEDTAVYYCAKGYHPFDYWGQGTLVTVSS

SEQ ID NO: 6164 - protein, 117 aa, Artificial Sequence
  Description of Artificial Sequence: Synthetic polypeptide
EVQLLESGGGLVQPGGSLRLSCAASGFTFPMVAMSWVRQAPGKGLEWVSSIARDGNVTYYADSVKGRFTISRDNSKNTLYLQMNSLRAEDAAVYYCAKVSPTGFDYWGQGTLVTVSS

SEQ ID NO: 6165 - protein, 116 aa, Artificial Sequence
  Description of Artificial Sequence: Synthetic polypeptide
EVQLLESGGGLVQPGGSLRLSCAASGFTFGHQDMSWVRQAPGKGLEWVSGITDDGESTYYADSVKGRFTISRDNSKNTLYLQMNSLRAEDTAVYYCAKGDYDFDYWGQGTLVTVSS

SEQ ID NO: 6166 - protein, 117 aa, Artificial Sequence
  Description of Artificial Sequence: Synthetic polypeptide
EVQLLESGGGLVQPGGSLRLSCAASGFTFGEYNMMWVRQAPGKGLEWVSQITRDGSRTYYADSVRGRFTISRDNSRNTLYLQMNSLRAEDSAVYYCAKLSNIGFDYWGQGTLVTVSS

SEQ ID NO: 6167 - protein, 116 aa, Artificial Sequence
  Description of Artificial Sequence: Synthetic polypeptide
EVQLLESGGGLVQPGGSLRLSCAASGFTFSDYSMIWARQAPGKGLEWVSSITPYGSYTYYADSVKGRFTISRDNSKNTLYLQMNSLRAEDTAVYYCAKTDYLFDYWGQGTLVTVSS

SEQ ID NO: 6168 - protein, 116 aa, Artificial Sequence
  Description of Artificial Sequence: Synthetic polypeptide
EVQLLESGGGLVQPGGSLRLSCAASGFTFDTYSMMWVRQAPGKGLEWVSTITPYGSSTYYADSVKGRFTISRDNSKNTLYLQMNSLRAEDTAVYYCAKWGLVFDYWGQGTLVTVSS

SEQ ID NO: 6169 - protein, 118 aa, Artificial Sequence
  Description of Artificial Sequence: Synthetic polypeptide
EVQLLESGGGLVQPGGSLRLSCAASGFTFTTGPMMWVRQAPGKGLEWVSAIGIGGDTTYYADSVKGRFTISRDNSKNTLYLQMNSLRAEDTAVYYCAKLTPSNQFDYWGQGTLVTVSS

SEQ ID NO: 6170 - protein, 119 aa, Artificial Sequence
  Description of Artificial Sequence: Synthetic polypeptide
EVQLLESGGGLVQPGGSLRLSCAASGFTFKQYQMMWVRQAPGKGLEWVSSITPSGFLTYYADSVKGRFTISRDNSKNTLYLQMNSLRAEDTAVYYCAEWNPFISTFDYWGQGTLVTVSS

SEQ ID NO: 6171 - protein, 120 aa, Artificial Sequence
  Description of Artificial Sequence: Synthetic polypeptide
EVQLLESGGGLVQPGGSLRLSCAASGFTFPNYDMVWVRQAPGKGLEWVSSISALGNVTYYADSVKGRFTISRDNSKNTLYLQTNSLRAEDTAVYYCAKWRSAITGNFDYWGQGTLVTVSS

SEQ ID NO: 6172 - protein, 123 aa, Artificial Sequence
  Description of Artificial Sequence: Synthetic polypeptide
EVQLLESGGGLVQPGGSLRLSCAASGFTFKEYQMSWVRQAPGKGLEWVSTISPSGMNTYYADSVKGRFTISRDNSKNTLYLQMNSLRAEDTAVYYCAEWRSVVRPWPGVFDYWGQGTLVTVSS

SEQ ID NO: 6173 - protein, 124 aa, Artificial Sequence
  Description of Artificial Sequence: Synthetic polypeptide
EVQLLESGGGLVQPGGSLRLSCAASGFTFERYPMTWVRQAPGKGLEWVSTIHGSGSATYYADSVKGRFTISRDNSKNTLYLQMNSLRAEDTAVYYCAKGPYTSRHNSLGHFDYWGQGTLVTVSS

SEQ ID NO: 6174 - protein, 121 aa, Artificial Sequence
  Description of Artificial Sequence: Synthetic polypeptide
EVQLLESGGGLVQPGGSLRLSCAASGFTFDDESMAWVRQAPGKGLEWVSSITPHGTFTYYADSVKGRFTISRDNSKNTLYLQMNSLRAEDTAVYYCAKLHLKLYESHFDYWGQGTLVTVSS

SEQ ID NO: 6175 - protein, 116 aa, Artificial Sequence
  Description of Artificial Sequence: Synthetic polypeptide
EVQLLESGGGLVQPGGSLRLSCAASGFTFEGGEMGWVRQAPGKGLEWVSMIPMDGSATYYADSVKGRFTISRDNSKNTLYLQMNSLRAEDTAVYYCAKAGSTFDYWGQGTLVTVSS

SEQ ID NO: 6176 - protein, 118 aa, Artificial Sequence
  Description of Artificial Sequence: Synthetic polypeptide
EVQLLESGGGLVQPGGSLRLSCAASGFTFDFMPMAWVRQAPGKGLEWVSSIGRDGAYTYYADSVKGRFTISRDNSKNTLYLQMNSLRAEDTAVYYCAKLASPAQFDYWGQGTLVTVSS

SEQ ID NO: 6177 - protein, 121 aa, Artificial Sequence
  Description of Artificial Sequence: Synthetic polypeptide
EVQLLESGGGLVQPGGSLRLSCAASGFTFGDEPMLWVRQAPGKGLEWVSSIGGTGTTTYYADSVKGRFTISRDNSKNTLYLQMNSLRAEDTAVYYCAKGNQGDFINRFHYWGQGTLVTVSS

SEQ ID NO: 6178 - protein, 119 aa, Artificial Sequence
  Description of Artificial Sequence: Synthetic polypeptide
EVQLLESGGGLVQPGGSLRLSCAASGFTFHAYNMAWVRQAPGKGLEWVSTISPRGSYTYYADSVKGRFTISRDNSKNTLYLQMNSLRAEDTAVYYCAKWPPPSSHFDYWGQGTLVTVSS

SEQ ID NO: 6179 - protein, 116 aa, Artificial Sequence
  Description of Artificial Sequence: Synthetic polypeptide
EVQLLESGGGLVQPGGSLRLSCAASGFTFDGYEMAWVRQAPGKGLEWVSSITSDGTSTYYADSVKGRFTISRDNSKNTLYLQMNSLRAEDTAVYYCAKPGLRFDYWGQGTLVTVSS

SEQ ID NO: 6180 - protein, 119 aa, Artificial Sequence
  Description of Artificial Sequence: Synthetic polypeptide
EVQLLESGGGLVQPGGSLRLSCAASGFTFEGYMMYWVHQAPGKGLEWVSSISPQGHFTYYADSVKGRFTISRDNSKNTLYLQMNSLRAEDTAVYYCAELRELPRLFDYWGQGTLVTVSS

SEQ ID NO: 6181 - protein, 123 aa, Artificial Sequence
  Description of Artificial Sequence: Synthetic polypeptide
EVQLLESGGGLVQPGGSLRLSCAASGFTFSSYAMGWVRQAPGKGLEWVSSIDASGGPTYYADSVKGRFTISRDNSKNTLYLQMNSLRAEDTAVYYCAKANGKKFPFTKYFDYWGQGTLVTVSS

SEQ ID NO: 6182 - protein, 123 aa, Artificial Sequence
  Description of Artificial Sequence: Synthetic polypeptide
EVQLLESGGGLVQPGGSLRLSCAASGFTFPSVHMAWVRQAPGKGLEWVSGINLTGVDTYYADSVKGRFTISRDNSKNTLYLQMNSLRAEDTAVYYCAKSATTRQAHPLYFDYWGQGTLVTVSS

SEQ ID NO: 6183 - protein, 118 aa, Artificial Sequence
  Description of Artificial Sequence: Synthetic polypeptide
EVQLLESGGGLVQPGGSLRLSCAASGFTFKEGEMYWVRQAPGKGLEWVSTISTNGLTTYYADSVKGRFTISRDNSKNTLYLQMNSLRAEDTAVYYCAKSTRDLGFAYWGQGTLVTVSS

SEQ ID NO: 6184 - protein, 123 aa, Artificial Sequence
  Description of Artificial Sequence: Synthetic polypeptide
EVQLLESGGGLVQPGGSLRLSCAASGFTFMDYPMGWVRQAPGKGLEWVSSIGPVGMSTYYADSVKGRFTISRDNSKNTLYLQMNSLRAEDTAVYYCAKYGGTSGRHNTKFDYWGQGTLVTVSS

SEQ ID NO: 6185 - protein, 116 aa, Artificial Sequence
  Description of Artificial Sequence: Synthetic polypeptide
EVQLLESGGGLVQPGGSLRLSCAASGFTFEEYEMAWARQAPGKGLEWVSFISPRGHFTYYADSVKGRFTISRDNSKNTLYLQMNSLRAEDTAVYYCAKPAKTFDYWGQGTLVTVSS

SEQ ID NO: 6186 - protein, 116 aa, Artificial Sequence
  Description of Artificial Sequence: Synthetic polypeptide
EVQLLESGGGLVQPGGSLRLSCAASGFTFDTYEMLWVRQAPGKGLEWVSRISVDGSITYYADSVKGRFTISRDNSKNTLYLQMNSLRAEDTAVYYCAKTRMRFDYWGQGTLVTVSS

SEQ ID NO: 6187 - protein, 124 aa, Artificial Sequence
  Description of Artificial Sequence: Synthetic polypeptide
EVQLLESGGGLVQPGGSLRLSCAASGFTFSSYAMSWVRQAPGKGLEWVSNISRDGSKTYYADSVKGRFTISRDNSKNTLYLQMNSLRAEDTAVYYCAEAQSGGLRSGLTTFDYWGQGTLVTVSS

SEQ ID NO: 6188 - protein, 119 aa, Artificial Sequence
  Description of Artificial Sequence: Synthetic polypeptide
EVQLLESGGGLVQPGGSLRLSCADSGFTFSSYAMSWVRQAPGKGLEWVSSIGRDGAYTYYADSVKGRFTISRDNSKNTLYLQMNSLRAEDTAVYYCAKAGPKGIAFDYWGQGTLVTVSS

SEQ ID NO: 6189 - protein, 116 aa, Artificial Sequence
  Description of Artificial Sequence: Synthetic polypeptide
EVQLLESGGGLVQPGGSLRLSCAASGFTFSPHAMAWVRQAPGKGLEWVSGIDGGGSMTYYADSVKGRFTISRDNSKNTLYLQMNSLRAEDTAVYYCAKSDPPFDYWGQGTLVTVSS

SEQ ID NO: 6190 - protein, 118 aa, Artificial Sequence
  Description of Artificial Sequence: Synthetic polypeptide
EVQLLESGGGLVQPGGSLRLSCAASGFTFHAGEMHWVRQAPGKGLEWVSSITLPGDMTYYADSVKGRFTISRDNSKNTLYLQMNSLRAEDTAVYYCAKPNTGYTFDYWGQGTLVTVSS

SEQ ID NO: 6191 - protein, 116 aa, Artificial Sequence
  Description of Artificial Sequence: Synthetic polypeptide
EVQLLESGGGLVQPGGSLRLSCAASGFTFGNYGMSWVRQAPGKGLEWVSSISWDGSLTYYADSVKGRFTISRDNSKNTLYLQMNSLRAEDTAVYYCAQNTRLFDYWGQGTLVTVSS

SEQ ID NO: 6192 - protein, 116 aa, Artificial Sequence
  Description of Artificial Sequence: Synthetic polypeptide
EVQLLESGGGLVQPGGSLRLSCAASGFTFHDADMLWVRQAPGKGLEWVSGILSPGEDTYYADSVKGRFTISRDNSKNTLYLQMNSLRAEDTAVYYCAKFGLPFDYWGQGTLVTVSS

SEQ ID NO: 6193 - protein, 116 aa, Artificial Sequence
  Description of Artificial Sequence: Synthetic polypeptide
EVQLLESGGGLVQPGGSLRLSCAASGFTFRTDQMNWVRQAPGKGLEWVSSISPSGAYTYYADSVKGRFTISRDNSKNTLYLQMNSLRAEDTAVYYCAKGLGAFDYWGQGTLVTVSS

SEQ ID NO: 6194 - protein, 120 aa, Artificial Sequence
  Description of Artificial Sequence: Synthetic polypeptide
EVQLLESGGGLVQPGGSLRLSCAASGFIFEQYQMVWVRQAPGKGLEWVSWISPDGTHTYYADSVKGRFTISRDNSKNTLYLQMNSLRAEDTAVYYCAKFSLRKMEKFDYWGQGTLVTVSS

SEQ ID NO: 6195 - protein, 123 aa, Artificial Sequence
  Description of Artificial Sequence: Synthetic polypeptide
EVQLLESGGGLVQPGGSLRLSCAASGFTFTEYPMSWVRQAPGKGLEWVSVISPLGFTTYYADSVKGRFTISRDNSKNTLYLQMNSLRAEDTAVYYCAKWTGGSGILNSSFDYWGQGTLVTVSS

SEQ ID NO: 6196 - protein, 116 aa, Artificial Sequence
  Description of Artificial Sequence: Synthetic polypeptide
EVQLLESGGGLVQPGGSLRLSCAASGFTFQDEQMAWVRQAPGKGLEWVSSIASDGMSTYYADSVKGRFTISRDNSKNTLYLQMNSLRAEDTAVYYCAQPGKNFDHWGQGTLVTVSS

SEQ ID NO: 6197 - protein, 120 aa, Artificial Sequence
  Description of Artificial Sequence: Synthetic polypeptide
EVQLLESGGGLVQPGGSLRLSCAASGFTFSDYAMSWVRQAPGKGLEWVSSITTGGERTYYADSVKGRFTISRDNSKNTLYLQMNSLRAEDTAVYYCAKRWNLYTESFDYWGQGTLVTVSS

SEQ ID NO: 6198 - protein, 117 aa, Artificial Sequence
  Description of Artificial Sequence: Synthetic polypeptide
EVQLLESGGGLVQPGGSLRLSCAASGFTFGGQPMDWVRQAPGKGLEWVSSIAPDGIHTYYADSVKGRFTISRDNSKNTLYLQMNSLRAEDTAVYYCAKNLGQGFDYWGQGTLVTVSS

SEQ ID NO: 6199 - protein, 116 aa, Artificial Sequence
  Description of Artificial Sequence: Synthetic polypeptide
EVQLLESGGGLVQPGGSLRLSCAASGFTFERYQMTWVRQAPGKGLEWVSSISPSGTFTYYADSVKGRFTISRDNSKNTLYLQMNSLRAEDTAVYYCAEWKALFDYWGQGTLVTVSS

SEQ ID NO: 6200 - protein, 117 aa, Artificial Sequence
  Description of Artificial Sequence: Synthetic polypeptide
EVQLLESGGGLVQPGGSLRLSCAASGFTFPHSTMYWVRQAPGKGLEWVSLILPSGSRTYYADSVKGRFTISRDNSKNTLYLQMNSLRAEDTAVYYCAKFSDERFDYWGQGTLVTVSS

SEQ ID NO: 6201 - protein, 117 aa, Artificial Sequence
  Description of Artificial Sequence: Synthetic polypeptide
EVQLSESGGGLVQPGGSLRLSCAASGFTFGDGNMDWVRQAPGKGLEWVSGISSDGVTTYYADSVKGRFTISRDNSKNTLYLQMNSLRAEDTAVYYCAKDRGQGFDYWGQGTLVTVSS

SEQ ID NO: 6202 - protein, 116 aa, Artificial Sequence
  Description of Artificial Sequence: Synthetic polypeptide
EVQLLESGGGLVQPGGSLRLSCAASGFTFDDYMMWWVRQAPGKGLEWVSSISPHGVYTYYADSVKGRFTISRDNSKNTLYLQMNSLRAEDTAVYYCAKWLHTFDYWGQGTLVTVSS

SEQ ID NO: 6203 - protein, 123 aa, Artificial Sequence
  Description of Artificial Sequence: Synthetic polypeptide
EVQLLESGGGLVQPGGSLRLSCAASGFTFSNYTMAWGRQAPGKGLEWVSFIAGPGNYTYYADSVKGRFTISRDNSKNTLYLQMNSLRAEDTAVYYCAKPGSTATYNNGQFDYWGQGTLVTVSS

SEQ ID NO: 6204 - protein, 122 aa, Artificial Sequence
  Description of Artificial Sequence: Synthetic polypeptide
EVQLLESGGGLVQPGGSLRLSCAASGFTFTEYSMVWVRQAPGKGLEWVSSISGSGRVTYYADSVKGRFTISRDNSKNTLYLQMNSLRAEDTAVYYCAKWLKLVRAPNPFDYWGQGTLVTVSS

SEQ ID NO: 6205 - protein, 120 aa, Artificial Sequence
  Description of Artificial Sequence: Synthetic polypeptide
EVQLLESGGGLVQPGGSLRLSCAASGFTFSNYQMAWVRQAPGKGLEWVSGISKTGHSTYYADSVKGRFTISRDNSRNTLYLQMNSLRAEDTAVYYCAKASHSLGPLFDYWGQGTLVTVSS

SEQ ID NO: 6206 - protein, 123 aa, Artificial Sequence
  Description of Artificial Sequence: Synthetic polypeptide
EVQLLESGGGLVQPGGSLRLSCAASGFRVSNYDLTWVRQAPGKGLEWVSTISATNGSTYYADSVKGRFTISRDNSKNTLYLQMNSLRAEDTAVYYCAAVTWWLLRHNDNLGFWGQGTLVTVSS

SEQ ID NO: 6207 - protein, 123 aa, Artificial Sequence
  Description of Artificial Sequence: Synthetic polypeptide
EVQLLESGGGLVQPGGSLRLSCAASGFTFTAYRMAWVRQAPGKGLEWVSWISPSGSGTYYADSVKGRFTISRDNSKNTLYLQMNSLRAEDTAVYYCAKTLTDSPSGHYEFDYWGQGTLVTVSS

SEQ ID NO: 6208 - protein, 123 aa, Artificial Sequence
  Description of Artificial Sequence: Synthetic polypeptide
EVQLLESGGGLVQPGGSLRLSCAASGFTFARYEMGWVRQAPGKGLEWVSRITAQGLGTYYADSVKGRFTISRDNSKNTLYLQMNSLRAEDTAVYYCAKYLTDFSSGHQEFDYWGQGTLVTVSS

SEQ ID NO: 6209 - protein, 122 aa, Artificial Sequence
  Description of Artificial Sequence: Synthetic polypeptide
EVQLLESGGGLVQPGGSLRLSCAASGFTFDDYGMSWVRQVPGKGLEWVSGISHNGMLTYYADSVKGRFTISRDNSKNTLYLQMNSLRAEDTAVYYCAKYWPSTSWETDFDYWGQGTLVTVSS

SEQ ID NO: 6210 - protein, 117 aa, Artificial Sequence
  Description of Artificial Sequence: Synthetic polypeptide
EVQLLESGGGSVQPGGSLRLSCAASGFTFGNEPMAWVRQAPGKGLEWVSSIEMQGKNTYYADSVKGRFTISRDNSKNTLYLQMNSLRAEDTAVYYCAKDRGQGFDYWGQGTLVTVSS

SEQ ID NO: 6211 - protein, 120 aa, Artificial Sequence
  Description of Artificial Sequence: Synthetic polypeptide
EVQLLESGGGLVQPGGSLRLSCAASGFTFGEEEMSWVRQAPGKGLEWVSCIDNLGSPTYYADSVKGRFTISRDNSKNTLYLQMNSLRAEDAAVYYCAKTISHQYDRFDYWGQGTLVTVSS

SEQ ID NO: 6212 - protein, 120 aa, Artificial Sequence
  Description of Artificial Sequence: Synthetic polypeptide
EVQLLESGGGLVQPGGSLRLSCAASGFTFGEEEMSWVRQAPGKGLEWVSSIDEGGRWTYYADSVKGRFTISRDNSKNTLYLQMNSLRAEDTAVYYCAKWTPHKQLSFDYWGQGTLVTVSS

SEQ ID NO: 6213 - protein, 116 aa, Artificial Sequence
  Description of Artificial Sequence: Synthetic polypeptide
EVQLLESGGGLVQPGGSLRLSCAASGFSFADEYMVWARQAPGKGLEWVSEIDPLGTGTYYADSVKGRFTISRDNSKNTLYLQMNSLRAEDTAVYYCAKYGTAFDYWGQGTLVTVSS

SEQ ID NO: 6214 - protein, 119 aa, Artificial Sequence
  Description of Artificial Sequence: Synthetic polypeptide
EVQLLESGGGLVQPGGSLRLSCAASGFTFSTHDMMWVRQAPGKGLEWVSSISDDGISTYYADSVKGRFTISRDNSKNTLYLQMNSLRAEDTAVYYCAKPDMSLIEFDYWGQGTLVTVSS

SEQ ID NO: 6215 - protein, 121 aa, Artificial Sequence
  Description of Artificial Sequence: Synthetic polypeptide
EVQLLESGGGLVQPGGSLRLSCAASGFTFDGTPMVWVRQAPGKGLEWVSGISGDGRNTYYADSVKGRFTISRDNSKNTLYLQMNSLRAEDTAVYYCAEPYALTSSKPFDYWGQGTLVTVSS

SEQ ID NO: 6216 - protein, 123 aa, Artificial Sequence
  Description of Artificial Sequence: Synthetic polypeptide
EVQLLESGGGLVQPGGSLRLSCAASGFTFNDYTMGWVRQAPGKGLEWVSWIHGTGGQTYYADSVKGRFTISRDNSKNTLYLQMNSLRAEDTAVYYCAKALADRSGGVVEFDYWGQGTLVTVSS

SEQ ID NO: 6217 - protein, 121 aa, Artificial Sequence
  Description of Artificial Sequence: Synthetic polypeptide
EVQLLESGGGLVQPGGSLRLSCAASGFSISYKNMAWVRQAPGKGLEWVSAIKAANGSTYYADSVKGRFTISRDNSKNTLYLQMNSLRAEDTAVYYCATGSQKKRTYTFDFWGQGTLVTVSS

SEQ ID NO: 6218 - protein, 120 aa, Artificial Sequence
  Description of Artificial Sequence: Synthetic polypeptide
EVQLLESGGGLVQPGGSLRLSCAASGFTFEAETMAWVRQAPGKGLEWVSCISNDGNTTYYADSVKGRFTISRDNSKNTLYLQMNSLRAEDTAVYYCAKESLISPGLFDYWGQGTLVTVSS

SEQ ID NO: 6219 - protein, 119 aa, Artificial Sequence
  Description of Artificial Sequence: Synthetic polypeptide
EVQLLESGGGLVQPGGSLRLSCAASGFTFTGEYMNWVRQAPGKGLEWVSTINETGYMTYYADSVKGRFTISRDNSKNTLYLQMNSLRAEDTAVYYCAKLSTRGVPFDYWGQGTLVTVSS

SEQ ID NO: 6220 - protein, 120 aa, Artificial Sequence
  Description of Artificial Sequence: Synthetic polypeptide
EVQLLESGGGLVQPGGSLRLSCAASGFTFRSYDMGWVRQAPGKGLEWVSTISPMGVFTYYADSVKGRFTISRDNSKNTLYLQMNSLRAEDTAVYYCAKSNQHAHDPFDYWGQGTLVTVSS

SEQ ID NO: 6221 - protein, 119 aa, Artificial Sequence
  Description of Artificial Sequence: Synthetic polypeptide
EVQLLESGGGLVQPGGSLRLSCAASGFTFSDYDMGWVRQAPGKGLEWVSSISPMGTFTYYADSVKGRFTISRDNSKNTLYLQMNSLRAEDTAVYYCAKAALTEPMFDYWGQGTLVTVSS

SEQ ID NO: 6222 - protein, 116 aa, Artificial Sequence
  Description of Artificial Sequence: Synthetic polypeptide
EVQLLESGGGLVQPGGSLRLSCAASGFTFRDYDMGWVRQAPGKGLEWVSTISPLGHFTYYADSVKGRSTISRDNSKNTLYLQMNSLRAEDTAVYYCAKAEEAFDYWGQGTLVTVSS

SEQ ID NO: 6223 - protein, 116 aa, Artificial Sequence
  Description of Artificial Sequence: Synthetic polypeptide
EVQLLESGGGLVQPGGSLRLSCAASGFAFPRYGMTWVRQAPGKGLEWVSNIDQFGMKTYYADSVKGRFTISRDNSKNTLYLQMNSLRAEDTAVYYCAEEYASFDYWGQGTLVTVSS

SEQ ID NO: 6224 - protein, 119 aa, Artificial Sequence
  Description of Artificial Sequence: Synthetic polypeptide
EVQLLESGGGLVQPGGSLRLSCAASGFTFDKYDMGWVRQAPGKGLEWVSTISPMGVFTYYADSVKGRFTISRDNSKNTLYLQMNSLRAEDTAVYYCAKGRGNTSDFDYWGQGTLVTVSS

SEQ ID NO: 6225 - protein, 118 aa, Artificial Sequence
  Description of Artificial Sequence: Synthetic polypeptide
EVQLLESGGGLVQPGGSLRLSCAASGFTFSNYDMAWVRQAPGKGLEWVSTISGAGHFTYYADSVKGRFTISRDNSKNTLYLQMNSLRAEDTAVYYCAKSFPRDEFDYWGQGTLVTVSS

SEQ ID NO: 6226 - protein, 118 aa, Artificial Sequence
  Description of Artificial Sequence: Synthetic polypeptide
EVQLLESGGGLVQPGGSLRLSCAASGFTFPKYEMRWVRQAPGKGLEWVSEIGLDGSPTYYADSVKGRFTISRDNSKNTLYLQMNSLRAEDTAVYYCAKLGDPNGFDYWGQGTLVTVSS

SEQ ID NO: 6227 - protein, 116 aa, Artificial Sequence
  Description of Artificial Sequence: Synthetic polypeptide
EVQLLESGGGLVQPGGSLRLSCAASGFTFPTSEMDWVRQAPGKGLEWVSGIGPDGLTTYYADSVKGRFTISRDNSKNTLYLQMNSLRAEDTAVYYCAKHADWFDYWGQGTLVTVSS

SEQ ID NO: 6228 - protein, 118 aa, Artificial Sequence
  Description of Artificial Sequence: Synthetic polypeptide
EVQLLESGGGLVQPGGSLRLSCAASGFTFRLYEMAWVRQAPGKGLEWVSGIDILGSRTYYADSVKGRFTISRDNSKNTLYLQMNSLRAEDTAVYYCAKDLSWQGFDYWGQGTLVTVSS

SEQ ID NO: 6229 - protein, 116 aa, Artificial Sequence
  Description of Artificial Sequence: Synthetic polypeptide
EVQLLESGGGLVQPGGSLRLSCAASGFTFSEYDMYWVRQAPGKGLEWVSWIDTDGGDTYYADSVKGRFTISRDNSKNTLYLQMNSLRAEDTAVYYCAKPGLKFDYWGQGTLVTVSS

SEQ ID NO: 6230 - protein, 117 aa, Artificial Sequence
  Description of Artificial Sequence: Synthetic polypeptide
EVQLLESGGGLVQPGGSLRLSCTASGFTFENASMQWVRQAPGKGLEWVSSIEGQGNATYYADSVKGRFTISRDNSKNTLYLQMNSLRAEDTAVYYCAKSSSWSFDYWGQGTLVTVSS

SEQ ID NO: 6231 - protein, 119 aa, Artificial Sequence
  Description of Artificial Sequence: Synthetic polypeptide
EVQLLESGGGLVQPGGSLRLSCAASGFTFTRNEMGWVRQAPGKGLEWVSTITPTGTFTYYADSVKGRFTISRDNSKNTLYLQMNSLRAEDTAVYYCAKTDPGNRYFDYWGQGTLVTVSS

SEQ ID NO: 6232 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESNFDYRGQGTLVTVSS

SEQ ID NO: 6233 - protein, 118 aa, Artificial Sequence
  Description of Artificial Sequence: Synthetic polypeptide
EVQLLESGGGLVQPGGSLRLSCAASGFTFNWQLMGWFRQAPGKGLEWVSGIEGPGDVTYYADSVKGRFTISRDNSKNTLYLQMNSLRAEDTAVYYCAKVGKESNFDYRGQGTLVTVSS

SEQ ID NO: 6234 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTVSRDNSKNTLYLQMNSLRAEDTAVYYCAKVGKESNSDYRGQGTLVTVSS

SEQ ID NO: 6235 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESNSDYRGQGTQVTVSS

SEQ ID NO: 6236 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKGRFTISRDNSKNTLYLQMNSLRAEDTAVYYCAKVGKESNSDYRGQGTLVTVSS

SEQ ID NO: 6237 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKDRFTISRDNSKNTLYLLMNSLRAEDTAVYYCAKVGKESNFDYWGQGTLVTVSS

SEQ ID NO: 6238 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNTKNTLYLQMNSLRAEDTAVYYCVKVGKESNSDYRGQGTLVTVSS

SEQ ID NO: 6239 - protein, 123 aa, Artificial Sequence
  Description of Artificial Sequence: Synthetic polypeptide
EVQLLESGGGLVQPGGSLRLSCAASGFTFRSYTMGWVRQAPGKGLEWVSSINPMGYQTYYADSVKGRFTISRDNSKNTLYLQMNSLRAEDTAVYYCAKHGVGKGTKPHNFDYWGQGTLVTVSS

SEQ ID NO: 6240 - protein, 118 aa, Artificial Sequence
  Description of Artificial Sequence: Synthetic polypeptide
EVRLLESGGGLVQPGGSLRLSCAASGFNFNWQLMGWIRQAPGKGLEWVSGIEGPGDVTYYADSVKGRFTISRDNSKNTLYLQMNSLRAEDTAVYYCAKVGKESNSDYRGQGTLVTVSS

SEQ ID NO: 6241 - protein, 118 aa, Artificial Sequence
  Description of Artificial Sequence: Synthetic polypeptide
EVQLLESGGGLVRPGGSLRLSCVASGFTFNWQLMGWVRQAPGKGLEWVSGIEGPGDVTYYADSVKGRFTISRDNSKNTLYLQMNSLRAEDTAVYYCAKVGKESNFDYRGQGTLVTVSS

SEQ ID NO: 6242 - protein, 118 aa, Artificial Sequence
  Description of Artificial Sequence: Synthetic polypeptide
EVQLLESGGGLVQTGGSLRLSCAASGFTYNWQLMGWVRQAPGKGLEWVSGIEGPGDVTYYADSVKGRFTISRDNSKNTLYLQMNSLRADDTAVYYCVKVGKESNFDYRGHGTLVTVSS

SEQ ID NO: 6243 - protein, 118 aa, Artificial Sequence
  Description of Artificial Sequence: Synthetic polypeptide
EVQLLESGGGLVQPGGSLRLSCAASGFTFNWQLMGWVRKAPGKGLEWVSGIEGPGDVTYYADSVKGRFTISRDNSKNTLYLQMNSLRAEDTAVYYCAKVGKESNFDYRGQGTLVTVSS

SEQ ID NO: 6244 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNTKNTLYLQMNSLRAEDTAVYYCAKVGKESNFDYRGQGTLVTVSS

SEQ ID NO: 6245 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESKFDYLGQGTLVTVSS

SEQ ID NO: 6246 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYAESVKGRFTISRDNSKNTLYLQMNSLRAEDTAVYYCAKVGKESNLDYRGQGTLVTVSS

SEQ ID NO: 6247 - protein, 118 aa, Artificial Sequence
  Description of Artificial Sequence: Synthetic polypeptide
EVQLFESGGGSVQPGGSLRLSCAASGFTFNWQLMGWVRQAPGKGLEWVSGIEGPGDVTYYADSVKGRFTISRDNSKNTLYLQMNSLRAEDTAVYYCAKVGKESNSDYRGQGTLVTVSS

SEQ ID NO: 6248 - protein, 118 aa, Artificial Sequence
  Description of Artificial Sequence: Synthetic polypeptide
EVQLLESGGGLVQPGGSLRLTCAASGFTFNWQLMGWVRQAPGKGLEWVSGIEGPGDVTYYADSVKGRFIISRDNSKNTLYLQMNSLRAEDTAVYYCAKVGKESNSDYRGQGTLVTVSS

SEQ ID NO: 6249 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSTNTLYLQMNSLRAEDTAVYYCAKVGKESEFDYRGQGTLVTVSS

SEQ ID NO: 6250 - protein, 123 aa, Artificial Sequence
  Description of Artificial Sequence: Synthetic polypeptide
EVQLLESGGGLVQPGGSLRLSCAASGFTFELYRMSWVRQAPGKGLEWVSEISGSGFPTYYADSVKGRFTISRDNSKNTLYLQMNSLRAEDTAVYYCAKSLHDKTQHHQEFDYWGQGTLVTVSS

SEQ ID NO: 6251 - protein, 118 aa, Artificial Sequence
  Description of Artificial Sequence: Synthetic polypeptide
EVRLLESGGGLVQPGGSLRLSCAASGFTFNWQLMGWVRQAPGKGLEWVSGIEGPGDVTYYADSVKGRFTITRDNSKNTLYLQMNSLRAEDTAVYYCVKVGKESNLDYRGQGTLVTVSS

SEQ ID NO: 6252 - protein, 118 aa, Artificial Sequence
  Description of Artificial Sequence: Synthetic polypeptide
EVQLLVSGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESNFDYRGQGTLVTVSS

SEQ ID NO: 6253 - protein, 118 aa, Artificial Sequence
  Description of Artificial Sequence: Synthetic polypeptide
EVQLLVSGGGLVQPGGSLRLSCAASGFTFNWQLMGWVRQAPGKGLEWVSGIEGPGDVTYYADSVKGRFTISRDNSKNMLYLQMNGLRAEDTAVYYCAKVGKESNFDYRGQGTLVTVSS

SEQ ID NO: 6254 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESNSDYRGQGTLVTVSS

SEQ ID NO: 6255 - protein, 118 aa, Artificial Sequence
  Description of Artificial Sequence: Synthetic polypeptide
EVQLLESGGGLVQPGGSLRLSCAASGFTFKWQLMGWARQAPGKGLEWVSGIEGPGDVTYYADPVKGRFTISRDNSKNTLYLQMNSLRAEDTAVYYCVKVGKESNSDYRGQGTLVTVSS

SEQ ID NO: 6256 - protein, 118 aa, Artificial Sequence
  Description of Artificial Sequence: Synthetic polypeptide
EVQLLESGGGLVQPGGSLRLSCAASGFTFKWHLMGWVRQAPGKGLEWVSGIEGPGDVTYYADSVKGRFTISRDNSKNTLYLQMNSLRAEDTAVYYCVKVGKESSSDYRGQGTLVTVSS

SEQ ID NO: 6257 - protein, 118 aa, Artificial Sequence
  Description of Artificial Sequence: Synthetic polypeptide
EVQLLESGGGLVQPGGSLRLSCAASGFTFNWHLMAWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 6258 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKESNSDYRGQGTLVTVSS

SEQ ID NO: 6259 - protein, 118 aa, Artificial Sequence
  Description of Artificial Sequence: Synthetic polypeptide
EVQLLESGGGLVQPGGSLRLSCAASGFTFKWQLMAWARQAPGKGLEWVSGIEGPGDITYYADSVKGRFTISRDNSKNTLYLQMNSLRAEDTAVYYCVKVGKESNSDYRGQGTLVTVSS

SEQ ID NO: 6260 - protein, 118 aa, Artificial Sequence
  Description of Artificial Sequence: Synthetic polypeptide
EVQLLESGGGLVQPGGSLRLSCAASGFTFNWHLMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 6261 - protein, 118 aa, Artificial Sequence
  Description of Artificial Sequence: Synthetic polypeptide
EVQLLESGGGLVQPGGSLRLSCAASGFTFIEYPMRWVRQAPGKGLEWVSLISPSGVFTYYADSVKGRFTISRDNSKNTLYLQMNSLRAEDTAVYYCAKGDESSTFDYWGQGTLVTVSS

SEQ ID NO: 6262 - protein, 118 aa, Artificial Sequence
  Description of Artificial Sequence: Synthetic polypeptide
EVQLLESGGGLVQPGGSLRLSCAASGFTFKWQLMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 6263 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 6264 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKGRFTISRDNSKNTLYLQMNSLRAEDTAVYYCVKVGKESNSDYRGQGTLVTVSS

SEQ ID NO: 6265 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSKSDYRGQGTLVTVSS

SEQ ID NO: 6266 - protein, 118 aa, Artificial Sequence
  Description of Artificial Sequence: Synthetic polypeptide
EVQLLESGGGLVQPGGSLRLSCAASGFTFNWQLMGWVRRAPGKGLEWVSGIEGPGDVTYYADSVKGRFTISRDNSKNTLYLQMNSLRAEDTAVYYCVKVGKDSKSDYRGQGTLVTVSS

SEQ ID NO: 6267 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSNSDYRGQGTLVTVSS

SEQ ID NO: 6268 - protein, 118 aa, Artificial Sequence
  Description of Artificial Sequence: Synthetic polypeptide
EVQLLESGGGLAQPGGSLRLSCAASGFTFNWQLMGWVRQAPGKGLEWVSGIEGPGDVTYYADSVKGRFTISRDNSKNTLYLQMNSLRAEDTAVYYCVKVGKDSKSDYRGQGTLVTVSS

SEQ ID NO: 6269 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDAKSDYRGQGTLVTVSS

SEQ ID NO: 6270 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDKNSDYRGQGTLVTVSS

SEQ ID NO: 6271 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESKSDYRGQGTLVTVSS

SEQ ID NO: 6272 - protein, 124 aa, Artificial Sequence
  Description of Artificial Sequence: Synthetic polypeptide
EVQLLESGGGLVQPGGSLRLSCAASGFTFKRYDMDWVRQAPGKGLEWVSTIGSSGYPTYYADSVKGRFTISRDNSKNTLYLQMNSLRAEDTAVYYCAERMPGYFPGFARQFDYWGQGTLVTVSS

SEQ ID NO: 6273 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGRDSKSDYRGQGTLVTVSS

SEQ ID NO: 6274 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKYSNSDYRGQGTLVTVSS

SEQ ID NO: 6275 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSRSDYRGQGTLVTVSS

SEQ ID NO: 6276 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDDSSDYRGQGTLVTVSS

SEQ ID NO: 6277 - protein, 118 aa, Artificial Sequence
  Description of Artificial Sequence: Synthetic polypeptide
EVQLLEFGGGLVQPGGSLRFSCAASGFTFNWQLMGWFRQAPGKGLEWVSGIEGPGDVTYYADSVKGRFTISRDNSKNTLYLQMNSLRAEDTAVYYCVKVGRDSNSDYRGQGTLVTVSS

SEQ ID NO: 6278 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKDSTSDYRGQGTLVTVSS

SEQ ID NO: 6279 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGKESSSDYRGQGTLVTVSS

SEQ ID NO: 6280 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTIFRDNSKNTLYLQMNSLRAEDTAVYYCVKVGKDSASDYRGQGTLVTVSS

SEQ ID NO: 6281 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCVKVGNDSYSDYRGQGTLVTVSS

SEQ ID NO: 6282 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNGLRAEDTAVYYCVKVGKDSSSDYRGQGTLVTVSS

SEQ ID NO: 6283 - protein, 124 aa, Artificial Sequence
  Description of Artificial Sequence: Synthetic polypeptide
EVQLLESGGGLVQPGGSLRLSCAASGFTFWRYAMGWVRQAPGKGLEWVSTINDEGRETYYADSVKGRFTISRDNSKNTLYLQMNSLRAEDTAVYYCAKKRVSSSVNAPYEFDYWGQGTLVTVSS

SEQ ID NO: 6284 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAIYYCVKVGKDSASDYRGQGTLVTVSS

SEQ ID NO: 6285 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKDAKSDYRGQGTLVTVSS

SEQ ID NO: 6286 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKDSRSDYRGQGTLVTVSS

SEQ ID NO: 6287 - protein, 118 aa, Artificial Sequence
  Description of Artificial Sequence: Synthetic polypeptide
EVQLLESGGGLVQPGGSLRLSCAASGFTFKWQLMGWVRQAPGKGLEWVSGIEGPGDVTYYADSVKGRFTISRDNSKNTLYLQMNSLRAEDTAVYYCVKVGKDSKSDYRGQGTLVTVSS

SEQ ID NO: 6288 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSS

SEQ ID NO: 6289 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDSRSDYRGQGTLVTVSS

SEQ ID NO: 6290 - protein, 118 aa, Artificial Sequence
  Description of Artificial Sequence: Synthetic polypeptide
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDSKSDYRGQGTLVTVSS

SEQ ID NO: 6291 - protein, 118 aa, Artificial Sequence
  Description of Artificial Sequence: Synthetic polypeptide
EVQLLESGGGLVQPGGSLRLSCAASGFTFNWQLMGWARQAPGKGLEWVSGIEGPGDVTYYADSVKGRFTISRDNSKNTLYLQMNSLRAEDSAVYYCAKVGKESNFDYLGQGTLVTVSS

SEQ ID NO: 6292 - protein, 118 aa, Artificial Sequence
  Description of Artificial Sequence: Synthetic polypeptide
EVQLLESGGGLVQPGGSLRLSCVASGFTFNWQLMGWVRQAPGKGLEWVSGIEGPGDVTYYADSVKGRFTISRDNSKNTLYLQMNSLRAEDTAVYYCAKVGKESNSDYRGQGTLVTVSS

SEQ ID NO: 6293 - protein, 118 aa, Artificial Sequence
  Description of Artificial Sequence: Synthetic polypeptide
EVQLLESGGGLVQPGGSLRLSCAASGFTFNWQLMGWVRQAPGKGLEWVSGIEGPGDVTYYADSVKGRFTISRDNSKNTLYLQMNSLRAEDTAVYYCAKVGKESNSDYRGQGTLVTVSS

SEQ ID NO: 6294 - protein, 123 aa, Artificial Sequence
  Description of Artificial Sequence: Synthetic polypeptide
EVQLLESGGGLVQPGGSLRLSCAASGFTFANYSMSWVRQAPGKGLEWVSSIDRLGTHTYYADSVKGRFTISRDNSKNTLYLQMNSLRAEDTAVYYCAKVLADLIAGHAEFDYWGQGTLVTVSS

SEQ ID NO: 6295 - protein, 120 aa, Artificial Sequence
  Description of Artificial Sequence: Synthetic polypeptide
EVQLLESGGGLVQPGGSLRLSCAASGFTFSGWEMGWVRQAPGKGLEWVSSIDESGLNTYYADSVKGRFTISRDNSKNTLYLQMNSLRAEDTAVYYCAEGAPQYQITFDYWGQGTLVTVSS

SEQ ID NO: 6296 - protein, 120 aa, Artificial Sequence
  Description of Artificial Sequence: Synthetic polypeptide
EVQLLESGGGLVQPGGSLRLSCAASGFTFPNYGMYWVRQAPGKGLEWVSYISRRGLLTYYADSVKGRFTISRDNSKNTLYLQMNSLRAEDTAVYYCAKTSHYMNNGFDYWGQGTLVTVSS

SEQ ID NO: 6297 - protein, 123 aa, Artificial Sequence
  Description of Artificial Sequence: Synthetic polypeptide
EVQLLESGGGLVQPGGSLRLSCAASGFTFVDYTMAWVRQAPGKGLEWVSSISPIGTFTYYADSVKGRFTISRDNSKNTLYLQMNSLRAEDTAVYYCAKDPYGMEDGLTWFDYWGQGTLVTVSS

SEQ ID NO: 6298 - protein, 124 aa, Artificial Sequence
  Description of Artificial Sequence: Synthetic polypeptide
QVQLVQSGAEVKKPGASSVKVSCKASGFNIKDTYIHWVRQAPGQRLEWMBRIDPANGYTKYDPKEQGRVTITADTSASTAYMELSSLRSEDTAVYYCAREGYYGNYGVYAMDYWGQGTLVTVSS

SEQ ID NO: 6299 - protein, 124 aa, Artificial Sequence
  Description of Artificial Sequence: Synthetic polypeptide
QVQLVQSGAEVKKPGASSVKVSCKASGFNIKDTYIHWVRQAPGQGLEWMBRIDPANGYTKYDPKFQGRVTITADTSASTAYMELSSLRSEDTAVYYCAREGYYGNYGVYAMDYWGQGTLVTVSS

SEQ ID NO: 6300 - protein, 124 aa, Artificial Sequence
  Description of Artificial Sequence: Synthetic polypeptide
QVQLVQSGAEVKKPGASSVKVSCKASGFNIKDTYIHWVRQAPGQRLEWMBRIDPANGYTKYDPKFQGRVTITADTSASTAYMELSSLRSEDTAVYYCAREGYFGNYGVYAMDYWGQGTLVTVSS

SEQ ID NO: 6301 - protein, 121 aa, Artificial Sequence
  Description of Artificial Sequence: Synthetic polypeptide
QVQLQESGPGLVRPSQTLSLTCTVSGFNIKDTYMHWVRQPPGRGLEWIGRIDPASGDTKYDPKFQVRVTMLVDTSSNTAWLRLSSVTAADTAVYYCADGMWVSTGYALDFWGQGTTVTVSS

SEQ ID NO: 6302 - protein, 120 aa, Artificial Sequence
  Description of Artificial Sequence: Synthetic polypeptide
QVQLQESPGLVRPSQTLSLTCTVSGFNIKDTYMHWVRQPPGRGLEWIGRIDPASGDTKYDPKFQVKATITADTSSNQFSLRLSSVTAADTAVYYCADGMWVSTGYALDFWGQGTTVTVSS

SEQ ID NO: 6303 - protein, 121 aa, Artificial Sequence
  Description of Artificial Sequence: Synthetic polypeptide
QVQLQESGPGLVRPSQTLSLTCTVSGFNIKDTYMHWVRQPPGRGLEWIGRIDPASGDTKYDPKFQVRVTMLVDTSSNQFSLRLSSVTSEDTAVYYCADGMWVSTGYALDFWGQGTTVTVSS

SEQ ID NO: 6304 - protein, 121 aa, Artificial Sequence
  Description of Artificial Sequence: Synthetic polypeptide
QVQLQESGPGLVRPSQTLSLTCTVSGFNIKDTYMHWVKQRPGRGLEWIGRIDPASGDTKYDPKFQVRVTMLVDTSSNQFSLRLSSVTAADTAVYYCADGMWVSTGYALDFWGQGTTVTVSS

SEQ ID NO: 6305 - protein, 121 aa, Artificial Sequence
  Description of Artificial Sequence: Synthetic polypeptide
QVQLQESGPGLVRPSQTLSLTCTASGFNIKDTYMHWVRQPPGRGLEWIGRIDPASGDTKYDPKFQVRVTMLVDTSSNQFSLRLSSVTAADTAVYYCADGMWVSTGYALDFWGQGTTVTVSS

SEQ ID NO: 6306 - protein, 121 aa, Artificial Sequence
  Description of Artificial Sequence: Synthetic polypeptide
QVQLQESGAEVVKPGSSVKLSCKASGFNIKDTYMHWVKQRPGQGLEWIGRIDPASGDTKYDPKFQVKATITADESTSTAYLELSSLRSEDTAVYYCADGMWVSTGYALDFWGQGTTVTVSS

SEQ ID NO: 6307 - protein, 117 aa, Artificial Sequence
  Description of Artificial Sequence: Synthetic polypeptide
EVQLVESGGGLVQPGGSLRLSCAASGFTFSDYYMSWVRQAPGKGLEWVGFIRNKANGYTTEYSASVKGRFTISRDDSKNSLYLQMNSLKTEDTAVYYCARYIWFDYWGQGTTVTVSS

SEQ ID NO: 6308 - protein, 121 aa, Artificial Sequence
  Description of Artificial Sequence: Synthetic polypeptide
EVKLLESGGGLVQPGGSMRLSCAGSGFTFTDFYMNWIRQPAGKAPEWLGFIRDKAKGYTTEYNPSVKGRFTISRDNTQNMLYLQMNTLRAEDTATYYCAREGHTAAPFDYWGQGVMVTVSS

SEQ ID NO: 6309 - protein, 114 aa, Artificial Sequence
  Description of Artificial Sequence: Synthetic polypeptide
EVKLEESGGGLVQPGGSMKLSCAASGFTFSDAWMDWVRQSPEKGLEWVAEIRNKAKNHVAYYAESVKGRFTISRDDSKSSVYLQMNNLRAEDTGIYYCTTLDSWGQGTALTVSS

SEQ ID NO: 6310 - protein, 119 aa, Artificial Sequence
  Description of Artificial Sequence: Synthetic polypeptide
QVNLRESGGGLVQPGRSLRLSCAASGFTFDDYAMHWVRQAPGKGLEWVSGISWNSGSIGYADSVKGRFTISRDNAKNSLYLQMNSLRAEDTALYYCAKDRSDRGRLLDYWGLGTLVTVS

SEQ ID NO: 6311 - protein, 112 aa, Artificial Sequence
  Description of Artificial Sequence: Synthetic polypeptide
QVQLQQSGGGVVQPGRSLGLSCAASFTFSSYGMNWVRQAPGKGLEWVSYISSSSSTIYADSVKGRFTISRDNSKNTLYLQMNSLRAEDTAVYYCARGPGMDVWGQGTTVTVS

SEQ ID NO: 6312 - protein, 98 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAR

SEQ ID NO: 6313 - protein, 118 aa, Artificial Sequence
  Description of Artificial Sequence: Synthetic polypeptide
QVQLVESGGGVVQPGRSLRLSCAASGFIFSGYGMHWVRQAPGKGLEWVTVIWYDGSNKYYADSVKGRFTISRDNSKNTLYLQMNSLRAEDTAVYYCARDTGDRFFDYWGQGTLVTVSS

SEQ ID NO: 6314 - protein, 120 aa, Artificial Sequence
  Description of Artificial Sequence: Synthetic polypeptide
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGSLVTVSS

SEQ ID NO: 6315 - protein, 120 aa, Artificial Sequence
  Description of Artificial Sequence: Synthetic polypeptide
QIQLVQSGPELKKPGETVKVTCKTSGYTFTNYGVNWIKQTPGEGLQWMGWINPNTGEPTFDDDFKGRFAFSLESSASTAFLQISNLKNEDMGTYFCSRSRGKNEAWFAYWGQGTLVTVSE

SEQ ID NO: 6316 - protein, 120 aa, Artificial Sequence
  Description of Artificial Sequence: Synthetic polypeptide
QVQLQQSGPELKKPGETVKVTCKTSGYTFTNYGVNWIKQTPGEGLQWMGWINPNTGEPTFDDDFKGRFAFSLESSASTAFLQISNLKNEDMGTYFCSRSRGKNEAWFAYWGQGTLVTVSS

SEQ ID NO: 6317 - protein, 120 aa, Artificial Sequence
  Description of Artificial Sequence: Synthetic polypeptide
QVQLVQSGSELKKPGASVKVSCKASGYTFTSYAMNWVRQAPGQGLEWMGWINTNTGNPTYAQGFTGRFVFSLDTSVSTAYLQISSLKADDTAVYYCAREDSNGYKIFDYWGQGSLVTVSS

SEQ ID NO: 6318 - protein, 120 aa, Artificial Sequence; identical to SEQ ID NO: 6315
  Description of Artificial Sequence: Synthetic polypeptide

SEQ ID NO: 6319 - protein, 120 aa, Artificial Sequence; identical to SEQ ID NO: 6316
  Description of Artificial Sequence: Synthetic polypeptide

SEQ ID NO: 6320 - protein, 111 aa, Artificial Sequence
  Description of Artificial Sequence: Synthetic polypeptide
DVVMTQSPLSLPVTLGQPASISCRSSQSLVHSDGNTYLNWFQQRPGQSPRRLIYKVSNRDSGVPDRFSGSGSGTDFTLKISRVEAEDVGVYYCMQGTHWPFTFGQGTRLEI

SEQ ID NO: 6321 - protein, 113 aa, Artificial Sequence
  Description of Artificial Sequence: Synthetic polypeptide
DIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKR

SEQ ID NO: 6322 - protein, 120 aa, Artificial Sequence; identical to SEQ ID NO: 6315
  Description of Artificial Sequence: Synthetic polypeptide

SEQ ID NO: 6323 - protein, 120 aa, Artificial Sequence; identical to SEQ ID NO: 6316
  Description of Artificial Sequence: Synthetic polypeptide

SEQ ID NO: 6324 - protein, 120 aa, Artificial Sequence; identical to SEQ ID NO: 6317
  Description of Artificial Sequence: Synthetic polypeptide

SEQ ID NO: 6325 - protein, 120 aa, Artificial Sequence; identical to SEQ ID NO: 6314
  Description of Artificial Sequence: Synthetic polypeptide

SEQ ID NO: 6326 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGREITSQNIVILLDYWGQGTLVTVSS

SEQ ID NO: 6327 - protein, 123 aa, Artificial Sequence
  Description of Artificial Sequence: Synthetic polypeptide
QVQLVESGGGVVQPGRSLRLSCAASGFTFSSYGMHWVRQAPDKGLEWVAVIWYDGSNKYYADSVKGRFTISRDNSKNTLYLQMNSLRAEDTAVYYCARGGTLVRGAMYGTDVWGQGTTVTVSS

SEQ ID NO: 6328 - protein, 124 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASGRYYGSGSYSSYFDYWGQGTLVTVSS

SEQ ID NO: 6329 - protein, 116 aa, Artificial Sequence
  Description of Artificial Sequence: Synthetic polypeptide
QVQLVQSGAEVKKPGASVKVSCKASGYTFTSYDISWVRQAPGQGLEWMGVIWTDGGTNYAQKLQGRVTMTTDTSTSTAYMELRSLRSDDTAVYYCARDQRLYFDVWGQGTTVTVSS

SEQ ID NO: 6330 - DNA, 355 bp, Artificial Sequence
  Description of Artificial Sequence: Synthetic polynucleotide
caggtgcagctggtggagtctgggggaggcgtggtccagcctgggaggtccctgagactctcctgtgcagcctctggattcaccttcagtagctatactatgcactgggtccgccaggctccaggcaaggggctggagtgggtgacatttatatcatatgatggaaacaataaatactacgcagactccgtgaagggccgattcaccatctccagagacaattccaagaacacgctgtatctgcaaatgaacagcctgagagctgaggacacggctatatattactgtgcgaggaccggctggctggggccctttgactactggggccagggaaccctggtcaccgtctcctcag

SEQ ID NO: 6331 - protein, 125 aa, Artificial Sequence
  Description of Artificial Sequence: Synthetic polypeptide
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSS

SEQ ID NO: 6332 - protein, 122 aa, Artificial Sequence
  Description of Artificial Sequence: Synthetic polypeptide
QVQLQQPGTELVKPGTSVKLSCKASGYTFTSYWMHWVKQRPGQGLEWIGNINPSDGGIKYNEKFKSKATLTVDKSSSTAYMELSSLTSEDSAVYYCAKWGGHYVLYWYFDVWGTGTTVTVSS

SEQ ID NO: 6333 - protein, 122 aa, Artificial Sequence
  Description of Artificial Sequence: Synthetic polypeptide
QVQLQQPGTELVKPGASVKLSCKASGYNFPTYWMHWVKQRPGQGLEWIGNINPSDGGTNFNEKFNNKATLTVDKSSSTAYMQLSSLTSEDSAVYYCAKWGGHYVLYWYFDVWGTGTTVTVSS

SEQ ID NO: 6334 - protein, 125 aa, Artificial Sequence
  Description of Artificial Sequence: Synthetic polypeptide
EVQVQQSGAELVRPGSSVKMSCKTSGYTFTNYGIIWVKQRPGQGLEWIGYIYIGKGYTEYNEKFKGKATLTSDTSSSTVYMQLSSLTSEDSAIYFCARGAHYYGNAMDYWDQGTSVTVSSNYGII

SEQ ID NO: 6335 - protein, 122 aa, Artificial Sequence
  Description of Artificial Sequence: Synthetic polypeptide
QVQLQQPGTELVKPGASVKLSCKASGYNFATYWVHWVKQRPGQGLEWIGNINPSDGGTSYNEKFSKKATLTVDKSSSTAYMELSSLTSEDSAVYYCAKWGGHYVLYWSFDVWGTGTTVTVSS

SEQ ID NO: 6336 - protein, 122 aa, Artificial Sequence
  Description of Artificial Sequence: Synthetic polypeptide
QVQLQQPGTELVKPGASVKLSCKASGYNFATYWMHWVKQRPGQGLEWIGNINPSDGGTNFNEKFNNKATLTVDKSSSTAYMHLSSLTSEDSAVYYCAKWGGHYVLYWYFDVWGTGTTVTVSS

SEQ ID NO: 6337 - protein, 127 aa, Artificial Sequence
  Description of Artificial Sequence: Synthetic polypeptide
QVQLQQPGTELVKPGASVKLSCKASGYNFATYWMHWVKQRPGQGLEWIGNINPSDGGTNFNEKFNNKATLTVDKSSSTAYMQLSSLTSEDSAVYYCAKWGGHYVLYWYFDVWGTGTTVTVSSTYWMH

SEQ ID NO: 6338 - protein, 122 aa, Artificial Sequence
  Description of Artificial Sequence: Synthetic polypeptide
QVQLQQPGTELVKPGASVKLSCKASGYNFATYWMHWVKQRPGQGLEWIGNINPSDGGTNYNEKFNNKATLTVDKSSSTAYMQLSSLTSEDSAVYYCAKWGGHYVLYWYFDVWGTGTTVTVSS

SEQ ID NO: 6339 - protein, 127 aa, Artificial Sequence
  Description of Artificial Sequence: Synthetic polypeptide
QVQLQQPGTELVKPGASVKLSCKASGYNFATYWMHWVKQRPGQGLEWIGNINPSDGGTNFNEKFNSKATLTVDKSSSTAYMQLSSLTSEDSAVYYCAKWGGHYVLYWYFDVWGTGTTVTVSSTYWMH

SEQ ID NO: 6340 - protein, 115 aa, Artificial Sequence
  Description of Artificial Sequence: Synthetic polypeptide
QVQLVESGGGLVQPGGSLRLSCAASGFTFNNYGMTWVRQAPGKGLEWVSGISGSGSYTYYADSVKGRFTISRDNSKNTLYLQMNSLRAEDTAVYYCARTIYMDYWGQGTLVTVSS

SEQ ID NO: 6341 - protein, 116 aa, Artificial Sequence
  Description of Artificial Sequence: Synthetic polypeptide
QVQLVESGGGLVQPGGSLRLSCAASGFTFSSYWMSWVRQAPGKGLEWVSGISYSGSNTHYADSVKGRFTISRDNSKNTLYLQMNSLRAEDTAVYYCARMGIDLDYWGQGTLVTVSS

SEQ ID NO: 6342 - protein, 116 aa, Artificial Sequence; identical to SEQ ID NO: 6341
  Description of Artificial Sequence: Synthetic polypeptide

SEQ ID NO: 6343 - protein, 116 aa, Artificial Sequence; identical to SEQ ID NO: 6341
  Description of Artificial Sequence: Synthetic polypeptide

SEQ ID NO: 6344 - protein, 116 aa, Artificial Sequence
  Description of Artificial Sequence: Synthetic polypeptide
QVQLVESGGGLVQPGGSLRLSCAASGFTFSSYWMSWVRQAPGKGLEWVSVISSDSSSTYYADSVKGRFTISRDNSKNTLYLQMNSLRAEDTAVYYCARHGIDFDHWGQGTLVTVSS

SEQ ID NO: 6345 - protein, 118 aa, Artificial Sequence
  Description of Artificial Sequence: Synthetic polypeptide
QVQLVESGGGLVQPGGSLRLSCAASGFTFSSYWMSWVRQAPGKGLEWVSSIEHKDAGYTTWYAAGVKGRFTISRDNSKNTLYLQMNSLRAEDTAVYYCARHGIDFDHWGQGTLVTVSS

SEQ ID NO: 6346 - protein, 116 aa, Artificial Sequence; identical to SEQ ID NO: 6344
  Description of Artificial Sequence: Synthetic polypeptide

SEQ ID NO: 6347 - protein, 116 aa, Artificial Sequence; identical to SEQ ID NO: 6344
  Description of Artificial Sequence: Synthetic polypeptide

SEQ ID NO: 6348 - protein, 118 aa, Artificial Sequence
  Description of Artificial Sequence: Synthetic polypeptide
QVQLVESGGGLVQPGGSLRLSCAASGFTFSSYWMSWVRQAPGKGLEWVSVIEHKDKGGTTYYAASVKGRFTISRDNSKNTLYLQMNSLRAEDTAVYYCARHGIDFDHWGQGTLVTVSS

SEQ ID NO: 6349 - protein, 120 aa, Artificial Sequence
  Description of Artificial Sequence: Synthetic polypeptide
QVQLVQSGAEVKKPGESLKISCKGSGYSFTNYYIGWVRQMPGKGLEWMGIIVPGTSYTIYSPSFQGQVTISADKSISTAYLQWSSLKASDTAMYYCARGIPFRMRGFDYWGQGTLVTVSS

SEQ ID NO: 6350 - protein, 124 aa, Artificial Sequence
  Description of Artificial Sequence: Synthetic polypeptide
QVQLVESGGGLVQPGGSLRLSCAASGFTFSNYGLHWVRQAPGKGLEWVSSISYYGSSTYYADSVKGRFTISRDNSKNTLYLQMNSLRAEDTAVYYCARDGSHMDKPPGYVFAFWGQGTLVTVSS

SEQ ID NO: 6351 - protein, 115 aa, Artificial Sequence; identical to SEQ ID NO: 6340
  Description of Artificial Sequence: Synthetic polypeptide

SEQ ID NO: 6352 - protein, 114 aa, Artificial Sequence
  Description of Artificial Sequence: Synthetic polypeptide
QVQLVESGGGLVQPGGSLRLSCAASGFTFSSYGMSWVRQAPGKGLEWVSGISGSGSYTYYADSVKGRFTISRDNSKNTLYLQMNSLRAEDTAVYYCARHYMDHWGQGTLVTVSS

SEQ ID NO: 6353 - protein, 115 aa, Artificial Sequence; identical to SEQ ID NO: 6340
  Description of Artificial Sequence: Synthetic polypeptide

SEQ ID NO: 6354 - protein, 116 aa, Artificial Sequence; identical to SEQ ID NO: 6341
  Description of Artificial Sequence: Synthetic polypeptide

SEQ ID NO: 6355 - protein, 116 aa, Artificial Sequence; identical to SEQ ID NO: 6344
  Description of Artificial Sequence: Synthetic polypeptide

SEQ ID NO: 6356 - protein, 120 aa, Artificial Sequence
  Description of Artificial Sequence: Synthetic polypeptide
QVQLVQSGAEVKKPGESLKISCKGSGYSFTNYYIGWVRQMPGKGLEWMGIIYPTDSYTNYSPSFQGQVTISADKSISTAYLQWSSLKASDTAMYYCARGIPFRMRGFDYWGQGTLVTVSS

SEQ ID NO: 6357 - protein, 115 aa, Artificial Sequence; identical to SEQ ID NO: 6340
  Description of Artificial Sequence: Synthetic polypeptide

SEQ ID NO: 6358 - protein, 115 aa, Artificial Sequence; identical to SEQ ID NO: 6340
  Description of Artificial Sequence: Synthetic polypeptide

SEQ ID NO: 6359 - protein, 118 aa, Artificial Sequence
  Description of Artificial Sequence: Synthetic polypeptide
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSS

SEQ ID NO: 6360 - protein, 123 aa, Artificial Sequence
  Description of Artificial Sequence: Synthetic polypeptide
QVQLVESGGGVVQPGRSLRLSCAASGFTFSSYGMHWVRQAPGKGLEWVSFLWYDGTNKNYVESVKGRFTISRDNSKNMLYLEMNSLRAEDTAVYYCARDHDFRSGYEGWFDPWGQGTLVTVSS

SEQ ID NO: 6361 - protein, 118 aa, Artificial Sequence
  Description of Artificial Sequence: Synthetic polypeptide
EVQLVESGGGLVQPGRSLKLSCAASGFTFSNYGMYWIRQAPTKGLQWVAFISHGGGITYYRDSVKGRFTISRDNAKSTLYLQMDSLRSEDTATYHCAALNWELGIDYWGQGVMVTVSS

SEQ ID NO: 6362 - protein, 118 aa, Artificial Sequence
  Description of Artificial Sequence: Synthetic polypeptide
EVQLVESGGGLVQPGRSMKLSCAASGFTFRNFPMAWVRQAPTRGLEWVATISSSDGTTYYRDSVKGRFTISRDNAKSTLYLQVNSLRSEDTATYYCSRGYYNSPFAYWGQGTLVTVSS

SEQ ID NO: 6363 - protein, 122 aa, Artificial Sequence
  Description of Artificial Sequence: Synthetic polypeptide
AVQLVESGGGLVQPKESLKISCAASGFTFSNAAMYWVRLAPGKGLEWVARIRTKPNNYATYYAESVKGRFTISRDDSKSMVYVQMDNLKTEDTAMYYCTAAPWRDSYAHVYWGQGVMVTVSS

SEQ ID NO: 6364 - protein, 116 aa, Artificial Sequence
  Description of Artificial Sequence: Synthetic polypeptide
EVQLVESGGGLVQPGRSLKLSCLASGFPFSSVWMTWIRQAPGKGLEWIATITNSGASTYYSASVKGRFTISRDNVKSTLYLQMTSLGSEDTATYYCTRVGTSFDYWGQGVMVTVSS

SEQ ID NO: 6365 - protein, 116 aa, Artificial Sequence
  Description of Artificial Sequence: Synthetic polypeptide
EVQLQQSGAELAKPGSSVKISCKASGYTFTNYDISWIKQTNGQGLEYLGYINTGSGGIYSNEKFKGKATLTVDKSSNTAFMQLSSLTPEDTAVYYCVREGNNFDHWGQGVKVTVSS

SEQ ID NO: 6366 - protein, 121 aa, Artificial Sequence
  Description of Artificial Sequence: Synthetic polypeptide
EVQLQQSGPELAKPGSSVKISCKASGYTFTNSYISWIKQTTGQGLEYVGYINTGSGGADYNEKFKGKATLTVDKSSRTAFMQLSSLTPGDSAVYYCAKSILLGSTCYFDYWGQGVLVTVSS

SEQ ID NO: 6367 - protein, 121 aa, Artificial Sequence
  Description of Artificial Sequence: Synthetic polypeptide
EVQLQQSGPELAKPGSSVKISCKASGYTFTSSYISWIKQTTGQGLEYIGYINTGSGGTDYNEKFKDKATLTVDKSSRTVFMQLSSLTPGDSAVYYCAKSILLGSTYYLDYWGQGVMVTVSS

SEQ ID NO: 6368 - protein, 118 aa, Artificial Sequence
  Description of Artificial Sequence: Synthetic polypeptide
EVQLVESGGGLVQPGGSLRLSCAASGFTFSNFPMAWVRQAPGKGLEWVATISSSDGTTYYRDSVKGRFTISRDNAKNSLYLQMNSLRAEDTAVYYCARGYYNSPFAYWGQGTLVTVSS

SEQ ID NO: 6369 - protein, 118 aa, Artificial Sequence
  Description of Artificial Sequence: Synthetic polypeptide
EVQLVESGGGLVQPGGSLRLSCAASGFTFSNFPMAWVRQAPGKGLEWVATISSSDGTTYYRDSVKGRFTISRDNAKNSLYLQMNSLRAEDTAVYYCSRGYYNSPFAYWGQGTLVTVSS

SEQ ID NO: 6370 - protein, 118 aa, Artificial Sequence
  Description of Artificial Sequence: Synthetic polypeptide
EVQLVESGGGLVQPGGSLRLSCAASGFTFSNFPMAWVRQAPGKGLEWVATISSSDGTTYYRDSVKGRFTISRDNSKSTLYLQMNSLRAEDTAVYYCSRGYYNSPFAYWGQGTLVTVSS

SEQ ID NO: 6371 - protein, 118 aa, Artificial Sequence
  Description of Artificial Sequence: Synthetic polypeptide
EVQLVESGGGVVQPGRSLRLSCAASGFTFSNYGMYWVRQAPGKGLEWVAFISHGGGITYYRDSVKGRFTISRDNSKNTLYLQMNSLRAEDTAVYYCARLNWELGIDYWGQGTMVTVSS

SEQ ID NO: 6372 - protein, 118 aa, Artificial Sequence
  Description of Artificial Sequence: Synthetic polypeptide
EVQLVESGGGVVQPGRSLRLSCAASGFTFSNYGMYWIRQAPGKGLEWVAFISHGGGITYYRDSVKGRFTISRDNSKSTLYLQMNSLRAEDTAVYHCAALNWELGIDYWGQGTMVTVSS

SEQ ID NO: 6373 - protein, 118 aa, Artificial Sequence
  Description of Artificial Sequence: Synthetic polypeptide
EVQLVESGGGVVQPGRSLRLSCAASGFTFSNYGMYWVRQAPGKGLEWVAFISHGGGITYYRDSVKGRFTISRDNSKNTLYLQMNSLRAEDTAVYYCAALNWELGIDYWGQGTMVTVSS

SEQ ID NO: 6374 - protein, 118 aa, Artificial Sequence
  Description of Artificial Sequence: Synthetic polypeptide
EVQLVESGGGLVQPGGSLRLSCAASGFTFSNYGMYWIRQAPGKGLEWVAFISHGGGITYYRDSVKGRFTISRDNSKSTLYLQMNSLRAEDTAVYHCAALNWELGIDYWGQGTMVTVSS

SEQ ID NO: 6375 - protein, 118 aa, Artificial Sequence; identical to SEQ ID NO: 6368
  Description of Artificial Sequence: Synthetic polypeptide

SEQ ID NO: 6376 - protein, 118 aa, Artificial Sequence
  Description of Artificial Sequence: Synthetic polypeptide
EVQLVESGGGLVQPGGSLRLSCAASGFTFRHFPMAWVRQAPGKGLEWVATISSSDAWPSYRDSVKGRFTISRDNAKNSLYLQMNSLRAEDTAVYYCSRGYYNSPFAYWGQGTLVTVSS

SEQ ID NO: 6377 - protein, 118 aa, Artificial Sequence
  Description of Artificial Sequence: Synthetic polypeptide
EVQLVESGGGLVQPGGSLRLSCAASGFTFGNFPMSWVRQAPGKGLEWVASISSSDSWATIGDSVKGRFTISRDNAKNSLYLQMNSLRAEDTAVYYCSRGYYNSPFAYWGQGTLVTVSS

SEQ ID NO: 6378 - protein, 118 aa, Artificial Sequence
  Description of Artificial Sequence: Synthetic polypeptide
EVQLVESGGGLVQPGGSLRLSCAASGFTFRNFPMAWVRQAPGKGLEWVATISSSDGWPTYRDSVKGRFTISRDNAKSSLYLQMNSLRAEDTAVYYCSRGYYNSPFAYWGQGTLVTVSS

SEQ ID NO: 6379 - protein, 118 aa, Artificial Sequence
  Description of Artificial Sequence: Synthetic polypeptide
EVQLVESGGGLVQPGGSLRLSCAASGFTFRHFPMAWVRQAPGKGLEWVATISSSDDWPNYRDSVKGRFTISRDNAKSSLYLQMNSLRAEDTAVYYCSRGYYNSPFAYWGQGTLVTVSS

SEQ ID NO: 6380 - protein, 118 aa, Artificial Sequence
  Description of Artificial Sequence: Synthetic polypeptide
EVQLVESGGGLVQPGGSLRLSCAASGFTFRYFPMSWVRQAPGKGLEWVASISGSDGWASYRDSVKGRFTISRDNAKNSLYLQMNSLRAEDTAVYYCARGYYNSPFASWGQGTLVTVSS

SEQ ID NO: 6381 - protein, 118 aa, Artificial Sequence
  Description of Artificial Sequence: Synthetic polypeptide
EVQLVESGGGLVQPGGSLRLSCAASGFTFRYFPMAWVRQAPGKGLEWVATISGSDEWPNYRDSVKGRFTISRDNAKNSLYLQMNSLRAEDTAVYYCARGYYNSPFAFWGQGTLVTVSS

SEQ ID NO: 6382 - protein, 118 aa, Artificial Sequence
  Description of Artificial Sequence: Synthetic polypeptide
EVQLVESGGGLVQPGGSLRLSCAASGFTFRYFPMSWVRQAPGKGLEWVASISGSDGWASYRDSVKGRFTISRDNAKNSLYLQMNSLRAEDTAVYYCARGYYNSPFAYWGQGTLVTVSS

SEQ ID NO: 6383 - protein, 118 aa, Artificial Sequence
  Description of Artificial Sequence: Synthetic polypeptide
EVQLVESGGGLVQPGGSLRLSCAASGFTFRHFPMAWVRQAPGKGLEWVATISSSDAWPSYRDSVKGRFTISRDNAKNSLYLQMNSLRAEDTAVYYCARGYYNSPFAYWGQGTLVTVSS

SEQ ID NO: 6384 - protein, 118 aa, Artificial Sequence
  Description of Artificial Sequence: Synthetic polypeptide
EVQLVESGGGLVQPGGSLRLSCAASGFTFGNFPMSWVRQAPGKGLEWVASISSSDSWATIGDSVKGRFTISRDNAKNSLYLQMNSLRAEDTAVYYCARGYYNSPFAFWGQGTLVTVSS

SEQ ID NO: 6385 - protein, 123 aa, Artificial Sequence [sequence omitted]

SEQ ID NO: 6386 - protein, 95 aa, Artificial Sequence
  Description of Artificial Sequence: Synthetic polypeptide
VSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTSS

SEQ ID NO: 6387 - protein, 120 aa, Artificial Sequence [sequence omitted]

SEQ ID NO: 6388 - protein, 119 aa, Artificial Sequence
  Description of Artificial Sequence: Synthetic polypeptide
QVQLQESGPGLVKPSETLSLTCTVSGFSISNYGVHWIRQSPGKGLEWIGVIWSGGNTDYNTPFTSRVTISKDNSKNQVSLKLSSVTAADTAVYYCARALTYYDYEFAYWGQGTLVTVSA

SEQ ID NO: 6389 - protein, 119 aa, Artificial Sequence
  Description of Artificial Sequence: Synthetic polypeptide
QVQLKQSGPGLVQPSQSLSITCTVSGFSLTNYGVHWIRQPPGKGLEWIGVIWSGGNTDYNTPFTSRLSINKDNSKSQVFFKMNSLQSNDTAIYYCARALTYYDYEFAYWGQGTLVTVSA

SEQ ID NO: 6390 - protein, 118 aa, Artificial Sequence
  Description of Artificial Sequence: Synthetic polypeptide
QVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVS

SEQ ID NO: 6391 - protein, 120 aa, Artificial Sequence
  Description of Artificial Sequence: Synthetic polypeptide
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSS

SEQ ID NO: 6392 - protein, 133 aa, Artificial Sequence
  Description of Artificial Sequence: Synthetic polypeptide
METGLRWLLLVAVLKGVQCQSVEESGGRLVTPGTPLTLTCKASGFSLSDSRVSWVRQAPGKGLEWIGIVGIGWNIYHANWAKGRFTISKTSSTTVDLKITSPTVEDTATYFCARGLGGGTVIWGPGTLVTVSL

SEQ ID NO: 6393 - protein, 135 aa, Artificial Sequence
  Description of Artificial Sequence: Synthetic polypeptide
METGLRWLLLVAVLKGVQCQSLEESGGRLVTPGTPLTLTCTVSGFSLSRNAINWVRQAPGKGLEYIGIIGSSGVTYYASWAKGRFTISRTSTTVDLKITSPTTEDTATYFCARNLYTGGSNDNLWGPGTLVTVSS

SEQ ID NO: 6394 - protein, 121 aa, Artificial Sequence
  Description of Artificial Sequence: Synthetic polypeptide
QVQLVQSGAEVKKPGASVKVSCKASGYTFTNYWIHWVRQAPGQGLEWMGVIDPSDTYPNYNKKFKGRVTMTTDTSTSTAYMELRSLRSDDTAVYYCARNGDSDYYSGMDYWGQGTTVTVSS

SEQ ID NO: 6395 - protein, 121 aa, Artificial Sequence
  Description of Artificial Sequence: Synthetic polypeptide
QVQLQQPVTELVRPGASVMLSCKASDYPFTNYWIHWVKQRPGQGLEWIGVIDPSDTYPNYNKKFKGKATLTVVVSSSTAYMQLSSLTSDDSAVYYCARNGDSDYYSGMDYWGQGTSVTVSS

SEQ ID NO: 6396 - protein, 121 aa, Artificial Sequence
  Description of Artificial Sequence: Synthetic polypeptide
QVQLVQSGAEVKKPGASVKVSCKASGYTFTNYWIHWVRQAPGQGLEWIGVIDPSDTYPNYNKKFKGRVTMTVVVSTSTAYMELRSLRSDDTAVYYCARNGDSDYYSGMDYWGQGTTVTVSS

SEQ ID NO: 6397 - protein, 116 aa, Artificial Sequence
  Description of Artificial Sequence: Synthetic polypeptide
EVKLEESGGGLVQPGGSMKLSCEASGFTFSDAWMDWVRQSPEKGLEWVAEIRNKAKNHATYYAESVIGRFTISRDDSKSSVYLQMNSLRAEDTGIYYCGALGLDYWGQGTTLTVSS

SEQ ID NO: 6398 - protein, 121 aa, Artificial Sequence; identical to SEQ ID NO: 6395
  Description of Artificial Sequence: Synthetic polypeptide

SEQ ID NO: 6399 - protein, 121 aa, Artificial Sequence; identical to SEQ ID NO: 6396
  Description of Artificial Sequence: Synthetic polypeptide

SEQ ID NO: 6400 - protein, 121 aa, Artificial Sequence
  Description of Artificial Sequence: Synthetic polypeptide
QVQLVQSGAEVKKPGASVKVSCKASGYTFTNYWIHWVRQAPGQGLEWIGVIDPSDTYPNYNKKFKGRVTMTVDTSTSTAYMELRSLRSDDTAVYYCARNGDSDYYSGMDYWGQGTTVTVSS

SEQ ID NO: 6401 - protein, 116 aa, Artificial Sequence; identical to SEQ ID NO: 6397
  Description of Artificial Sequence: Synthetic polypeptide

SEQ ID NO: 6402 - protein, 108 aa, Artificial Sequence
  Description of Artificial Sequence: Synthetic polypeptide
QIVMTQSPATLSVSPGERATLSCRASQSVGSYVDWYQQKPGQAPRLLIYGASTRYTGIPARFSGSGSGTEFTLTISSLQSEDFAVYYCLQYNNHPYTFGQGTKLEIKR

SEQ ID NO: 6403 - protein, 106 aa, Artificial Sequence; identical to SEQ ID NO: 3203
  Description of Artificial Sequence: Synthetic polypeptide

SEQ ID NO: 6404 - protein, 120 aa, Artificial Sequence
  Description of Artificial Sequence: Synthetic polypeptide
EVQLVQSGAEVKKPGESLKVSCKASGYTFTSYYMHWVRQAPGQGLEWMGIINPSGGSTSYAQKFQGRVTMTRDTSTSTVYMELSSLRSEDTAVYYCARGSAYYYDFADYWGQGTLVTVSS

SEQ ID NO: 6405 - protein, 119 aa, Artificial Sequence
  Description of Artificial Sequence: Synthetic polypeptide
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSS

SEQ ID NO: 6406 - protein, 121 aa, Artificial Sequence
  Description of Artificial Sequence: Synthetic polypeptide
EVQLVESGGGVVQPGRSLRLSCAASGFTFSSYGMHWVRQAPGKGLEWVSFIWYDGSNKYYADSVKGRFTISRDNSKNTLYLQMNSLTAEDTAVYYCARRGILTGTTAFDIWGQGTMVTVSS

SEQ ID NO: 6407 - protein, 121 aa, Artificial Sequence
  Description of Artificial Sequence: Synthetic polypeptide
QVQLVESGGGVVQPGRSLRLSCAASGFSFSDYVMHWVRQAPGKGLEWVASIWFDGSNELYADSVKGRFTISRDNSKNTLFLQMNSLRAEDTAVYYCAKKGVLVATSAFHIWGQGTMVTVSS

SEQ ID NO: 6408 - protein, 124 aa, Artificial Sequence
  Description of Artificial Sequence: Synthetic polypeptide
EVQLVESGGGLVQPGGSLRLSCAASGFTFSSYAMSWVRQAPGKGLEWVSVISGSGGSTYYADAVKGRFTISRDNSKHTLYLQMNSLRAEDTAVYYCTKPSSYSSSNFYYGMDVWGQGSTVTVSS

SEQ ID NO: 6409 - protein, 124 aa, Artificial Sequence
  Description of Artificial Sequence: Synthetic polypeptide
EVQLVESGGGLVQAGGSLRLSCVASGFTFSSYAMSWVRQAPGKGLEWVSAISGSGGSTYSADSVKGRFTISRDNSKNTLYLQMNSLRAEDTAVYYCTKPSSYSSSNFYYGMDVWGQGTTVTVSS

SEQ ID NO: 6410 - protein, 124 aa, Artificial Sequence
  Description of Artificial Sequence: Synthetic polypeptide
EVQLVESGGGLVQPGGSLRLSCAASGFTFSSYAMSWVRQAPGKGLEWVSVISGSGGSTYYADSVKGRFTISRDNSKNTLYLQMNSLRAEDTAVYYCAKPSSYSSSNFYYGMDVWGQGTTVTVSS

SEQ ID NO: 6411 - protein, 120 aa, Artificial Sequence
  Description of Artificial Sequence: Synthetic polypeptide
EVQLLESGGGLVQPGGSLRLSCAASGFTFSSYAMSWVRQGPGKGLEWVSGISGSGGSTYNADSVKGRFTISRDNSKNTLYLQMNSLRAEDTAVYYCAKDSGTYWYYFDYWGQGILVTVSS

SEQ ID NO: 6412 - protein, 123 aa, Artificial Sequence
  Description of Artificial Sequence: Synthetic polypeptide
EVQLVESGAEVKKSGSSVKVSCKASGGTFSRYAISWVRQAPGQGLEWMGGIIPLFGTLNYAQKFQGRVTLTTDESTSTAYMELSSLRSEDTAVYYCAVFYYGSGSYRNWFDPWGQGTLVTVSS

SEQ ID NO: 6413 - protein, 120 aa, Artificial Sequence
  Description of Artificial Sequence: Synthetic polypeptide
EVQLVESGGGLVQPGRSLRLSCAASGFTFNDYAMHWVRQAPGKGLEWVSGISWNSGNIGYADSVKGRFTISRDNAKNSLYLQMNSLRAEDTALYFCARDTRMATRPFDYWGQGTLVTVSS

SEQ ID NO: 6414 - protein, 119 aa, Artificial Sequence
  Description of Artificial Sequence: Synthetic polypeptide
EVQLLESGGGLVQPGGSLRLSCAASGFTFSTYAMSWVRQAPGKGLEWVSAIRGNGVNTYYGDSMKGRFTISRDNSKDTLYLQMNSLRAEDTAVYYCAKNKWELLVFEYWGQGTLVTVSS

SEQ ID NO: 6415 - protein, 121 aa, Artificial Sequence
  Description of Artificial Sequence: Synthetic polypeptide
EVQLVESGGGVVQPGRSLRLSCAASGFSFSDYVMHWVRQAPGKGLEWVASIWFDGSNEFYADSVKGRFTISRDNSKNTLFLQMNSLRAEDTAVYYCAKKGVLVATSAFDIWGQGTMVTVSS

SEQ ID NO: 6416 - protein, 120 aa, Artificial Sequence
  Description of Artificial Sequence: Synthetic polypeptide
EVQLVESGGGLVRPGRSLRLSCAASGFTFDNYAMHWVRQVPGKGLEWVSGITWNSVSLGYADSVKGRFTISRDNAQNSLYLQMNSLRTVDTALYYCAKDRWGGSYYFDFWGQGTLVTVSS

SEQ ID NO: 6417 - protein, 121 aa, Artificial Sequence
  Description of Artificial Sequence: Synthetic polypeptide
QVQLVESGGGVVQPGRSLRLSCAASGFSFSDYVMHWVRQAPGKGLEWVASIWFDGSNEFYADSVKGRFTISRDNSKNTLFLQMNSLRAEDTAVYYCAKKGVLVATSAFDIWGQGTMVTVSS

SEQ ID NO: 6418 - protein, 120 aa, Artificial Sequence
  Description of Artificial Sequence: Synthetic polypeptide
EVQLVQSGAEVKKPGASVKVSCKASGYTFTNYGITWVRQAPGQGLEWMGWISAYNGNTGYAQKFQGRVTMTTDTSTSTAYMELRSLRSDDTAVYYCAREDYDFWRAFDIWGQGTMVTVSS

SEQ ID NO: 6419 - protein, 121 aa, Artificial Sequence; identical to SEQ ID NO: 6417
  Description of Artificial Sequence: Synthetic polypeptide

SEQ ID NO: 6420 - protein, 120 aa, Artificial Sequence
  Description of Artificial Sequence: Synthetic polypeptide
EVQLVESGGGLVQPGGSLRLSCAASGFTFSSYAMSWVRQVPGKGLEWVSAISGSGDNTYNAESVKGRFTISRDNSKNMLYLQMNSLRAEDTAVYYCAKTKFSSSLLFDYWGQGTLVTVSS

SEQ ID NO: 6421 - protein, 124 aa, Artificial Sequence
  Description of Artificial Sequence: Synthetic polypeptide
EVQLVESGGGLVQPGGSLRLSCAASTFTFSSYAMTWVRQAPGKGLEWVSSISGSGDSTYYADSVKGRFTISRDNSKNTLFLQMNSLRAEDTAVYYCAKKDGPGRYYVRYGMDVWGQGTTVTVSS

SEQ ID NO: 6422 - protein, 123 aa, Artificial Sequence
  Description of Artificial Sequence: Synthetic polypeptide
EVQLLESGGNLVQPGGSLRLSCAASGFTFSSYAMTWVRQAPGKGLEWVSTISGSGTSTYYADSVKGRFTISRDNSRDTVFLQMNSLRAEDTAVYYCSKPSALRFLHWLAMDVWGQGTLVTVSS

SEQ ID NO: 6423 - protein, 124 aa, Artificial Sequence
  Description of Artificial Sequence: Synthetic polypeptide
EVQLVESGGGLEQPGGSLRLSCAASGFTFSSYVMSWVRQVPGKGLEWVSVISGSGGSTYYADSVKGRFTISRDNSKNTLYLQMNSLRAEDTAVYYCAKPSSYSSSNFHYGMDVWGQGTTVTVSS

SEQ ID NO: 6424 - protein, 124 aa, Artificial Sequence
  Description of Artificial Sequence: Synthetic polypeptide
QVQLVQSGAEVKKPGASVKVSCKASGYTFTSYGIIWVRQAPGQGLEWMGWISGYNGNTNYTQNLQGRVTMTTDTSTTTAYMELRSLRSDDTAVYYCARWGIATRPYYYYGMDVWGQGTTVTVSS

SEQ ID NO: 6425 - protein, 123 aa, Artificial Sequence
  Description of Artificial Sequence: Synthetic polypeptide
EVQLLESGGNLVQPGGSLRLSCAASGFTFSSYAMTWVRQAPGKGLEWVSTISGSGTSTYYADSVKGRFTISRDNSRDTVFLQMNSLRAEDTAVYYCSKPSALRFLHWLCMDVWGQGTLVTVSS

SEQ ID NO: 6426 - protein, 124 aa, Artificial Sequence
  Description of Artificial Sequence: Synthetic polypeptide
QVQLVQSGAEVKKPGASVKVSCKASGYTFTSYGIIWVRQAPGQGLEWMGWISGYNGNTNYAQNLQGRVTMTTDTSTTTAYMELRSLRSDDTAVYYCARWGIATRPYYYYGMDVWGQGTTVTVSS

SEQ ID NO: 6427 - protein, 121 aa, Artificial Sequence
  Description of Artificial Sequence: Synthetic polypeptide
EVQLLESGGGLVQPGGSLRVSCAASGFTFSTSAMSWVRQAPGKGLEWVSGISGIGGGSTYYADSVKGRFTISRDNSKNTLYLQMNSLRAEDTAVYFCAKFYKWNSYIFDLWGQGTMVTVSS

SEQ ID NO: 6428 - protein, 120 aa, Artificial Sequence
  Description of Artificial Sequence: Synthetic polypeptide
EVQLLESGGGLVQSGGSLRLSCAASGFSFNNYAMSWVRQAPGKGLEWVSFISGSGGSTYYADSVKGRFTISRDNSKNTLYLQMNSLRVEDTAVFYCAKDRYNYGTFFDYWGQGTLVTVSS

SEQ ID NO: 6429 - protein, 124 aa, Artificial Sequence
  Description of Artificial Sequence: Synthetic polypeptide
EVQLVESGGGLVQPGESLRLSCAASGFTFSNYAMSWVRQAPGKGLEWVSVISGSGGSTYYADSVKGRFTMSRDNSKNTLYLQMNSLRAEDTAVYYCAKPPSRAARYFNYGMDVWGQGTTVTVSS

SEQ ID NO: 6430 - protein, 115 aa, Artificial Sequence
  Description of Artificial Sequence: Synthetic polypeptide
QVQLVQSGGGVVQPGRSLRLSCAASGFTFSSYGMHWVRQAPGKGLEWVAFIRYDGSNKYYADSVKGRFTISRDNSKNTLYLQMKSLRAEDTAVYYCKTHGSHDNWGQGTMVTVSS

SEQ ID NO: 6431 - protein, 115 aa, Artificial Sequence [sequence omitted]

SEQ ID NO: 6432 - protein, 116 aa, Artificial Sequence
  Description of Artificial Sequence: Synthetic polypeptide
QVQLQQPGAELVRPGASVQLSCKASGYTFTSSWIHWVNQRPGQGLEWIGMIHPSDSETRLNQKFKDKATLTVDKSSSTAYMQLSSPTSEDSAVYYCASTATDFDYWGQGTTLTVSS

SEQ ID NO: 6433 - protein, 116 aa, Artificial Sequence
  Description of Artificial Sequence: Synthetic polypeptide
QVRLQQPGAELVRPGASVKLSCKASGYTFTSSWIHWVNQRPGQGLEWIGMIHPSDSETRLNQKFKDKATLTVDKSSSTAYMQLSSPTSEDSAVYYCASTATDFDYWGQGTTLTVSS

SEQ ID NO: 6434 - protein, 120 aa, Artificial Sequence
  Description of Artificial Sequence: Synthetic polypeptide
QVQLQQSGDDLVKPGASVKLSCKASGYTFTSYWINWIKQRPGQGLEWIGHIAPGSGETYDNEMFKDKAKLTVDTSSNTAYIHLSSLSSEDSAVYFCARGSFTFFYAMDYWGQGTSVTVSS

SEQ ID NO: 6435 - protein, 120 aa, Artificial Sequence
  Description of Artificial Sequence: Synthetic polypeptide
QVQLQQSGDDLVKPGASVKLSCKASGYTFTSYWINWIKQRPGQGLEWIGHIAPGSGETYDNEMFKDKAKLTVDTSSSTAYIHLSSLSSEDSAVYFCARGSFTFFYAMDYWGQGTSVTVSS

SEQ ID NO: 6436 - protein, 123 aa, Artificial Sequence
  Description of Artificial Sequence: Synthetic polypeptide
QVQLQQSGAELARPGTSVKLSCKASGYTFTTYGISWVKQRTGQGLEWIGEIYPGSYNTYYNEKFRGKATLTADKSSSTAYMQLSSLTSEDSAVYFCSRWRTSYFSDYGYFDYWGQGTTLTVSS

SEQ ID NO: 6437 - protein, 123 aa, Artificial Sequence
  Description of Artificial Sequence: Synthetic polypeptide
QVQLQQSGAELARPGTSVKLSCKASGYTFTTYGVSWVKQRTGQGLEWIGEIYPGNYNTYYNEKFRGKATLTADKSSSTAYMQLSSLTSEDSAVYFCSRWRTSYFSDYGYFDYWGQGTTLTVSS

SEQ ID NO: 6438 - protein, 111 aa, Artificial Sequence
  Description of Artificial Sequence: Synthetic polypeptide
EVQLVESGGGLVKPGGSLKLSCAASGFTFSTYAMSWVRQTPEKRLEWVAGISSGGSYTYYPETMKGRFTISRDNARNTLYLQMSSLRSEDTAIYYCTRGSWGQGTSVTVSS

SEQ ID NO: 6439 - protein, 117 aa, Artificial Sequence
  Description of Artificial Sequence: Synthetic polypeptide
EVKLVESGGGLVRPGGSLKLSCAASGFTFSSYAMNWVRQTPEKRLEWVASISSGGNIYYSDSVKGRFTISRDNARNTLHLQMSSLRSEDTAMYYCARDGYLYAMDYWGQGTSVTVSS

SEQ ID NO: 6440 - protein, 123 aa, Artificial Sequence
  Description of Artificial Sequence: Synthetic polypeptide
QVTLKESGPGILQPSQTLSLTCSFSGFSLSTSDMGVDWIRQPSGKGLEWLAHIWWDDVKRYNPALKSRLTISKDTSSSQVFLMLASVDTADTATYYCARTVSSGYIYYAMDYWGQGTSVTVSS

SEQ ID NO: 6441 - protein, 66 aa, Artificial Sequence
  Description of Artificial Sequence: Synthetic polypeptide
VKRYNPALKSRLTISKDTSSSQVFLMLASVDTADTATYYCARIVSSGYIYYALDYWGQGTSVTVSS

SEQ ID NO: 6442 - protein, 123 aa, Artificial Sequence
  Description of Artificial Sequence: Synthetic polypeptide
QVTLKESGPGILQPSQTLSLTCSFSGFSLSTSDLGVGWIRQPSGKGLEWLAHIWWDDVKRYNPALKSRLTISKDTSSSQVFLMIASVDTADTATYYCARIGSSGYIYYEMDYWGQGTSVTVSS

SEQ ID NO: 6443 - protein, 118 aa, Artificial Sequence
  Description of Artificial Sequence: Synthetic polypeptide
EVQLQQSGAEFVRPGALVKLSCKASGFNIKDYYMYWVKQRPEQGLEWIGRIDPENGNTIYDPKFQGKASITGDTSSNTAYLQLSSLTSEDTAVYYCARYAYYGPFDYWGQGTTLTVSS

SEQ ID NO: 6444 - protein, 110 aa, Artificial Sequence
  Description of Artificial Sequence: Synthetic polypeptide
QAVVTQESALTTSPGETVTLTCRSSIGTVTTNNYANWVQEKPDHLFTGLIGSTNNRAPGVPARFSGSLIGDKAALTITGAQTEDEAIYFCALWYSNHWVFGGGTKLTVLG

SEQ ID NO: 6445 - protein, 112 aa, Artificial Sequence
  Description of Artificial Sequence: Synthetic polypeptide
NIVLTQSPASLAVSLGQRATISCRASETVDSYGKSYLHWYQQKPGQPPKLLIYLASNLESGVPARFSGSGSRTDFTLIIDPVEADDAATYYCQQNNEGPRTFGGGTKLEIKR

SEQ ID NO: 6446 - protein, 112 aa, Artificial Sequence
  Description of Artificial Sequence: Synthetic polypeptide
NIVLTQSPASLAVSLGQRATIFCRASESVDSYGNSFMHWYQQKSGQPPKLLIYLASNLESGVPARFSGSGSRTDFTLTIDPVEADDAATFYCQQNNENPRTFGGGTKLEIKR

SEQ ID NO: 6447 - protein, 112 aa, Artificial Sequence
  Description of Artificial Sequence: Synthetic polypeptide
NIVLTQSPASLAVSLGQRATISCRASESVDSYGNSFMHWYQQKPGQPPKLLIYLASNLESGVPARFSGSGSRADFTLTIDPVEADDAATYYCQQNNENPRTFGGGTKLEIKR

SEQ ID NO: 6448 - protein, 112 aa, Artificial Sequence
  Description of Artificial Sequence: Synthetic polypeptide
NIVLTQSPASLAVSLGQRATISCRASETVDSYGNSFMHWYQQKPGQPPKLLIYLASNLESGVPARFSGSGSRTDFTLTIDPVEADDAATYYCQQNNEDPRTFGGGTKLEIKR

SEQ ID NO: 6449 - protein, 112 aa, Artificial Sequence
  Description of Artificial Sequence: Synthetic polypeptide
HIVLTQSPASLAVSLGQRATISCRASETVDSYGSSFLHWYQQKPGQPPKLLIYLASKLESGVPARFSGSGSRTDFTLTIDPVEADDAATYYCQQNNEGPRTFGGGSKLEIKR

SEQ ID NO: 6450 - protein, 121 aa, Artificial Sequence
  Description of Artificial Sequence: Synthetic polypeptide
QIQLVQSGPELKKPGETVKISCKASGFTFTNYGMNWVKQAPGKGLKWMGWINTYTREPTYADDFKGRFAFSLETSASTAYLQINNLKNEDTAKYFCARDITAVVPTGFDYWGQGTTLTVSS

SEQ ID NO: 6451 - protein, 121 aa, Artificial Sequence
  Description of Artificial Sequence: Synthetic polypeptide
QVQLQQSGSELKKPGASVKVSCKASGFTFTNYGMNWVKQAPGQGLKWMGWINTYTREPTYADDFKGRFAFSLDTSVSTAYLQISSLKADDTAVYFCARDITAVVPTGFDYWGQGSLVTVSS

SEQ ID NO: 6452 - protein, 120 aa, Artificial Sequence
  Description of Artificial Sequence: Synthetic polypeptide
QIQLVQSGPELKKPGETVKISCKASGFTFTNYGMNWVKQAPGKGLKWMGWINTYTREPTYADDFKGRFAFSLETSASTAYLQINNLKNEDTAKYFCARDITAVVPTGFDYWGQGTTLTVS

SEQ ID NO: 6453 - protein, 121 aa, Artificial Sequence; identical to SEQ ID NO: 6451
  Description of Artificial Sequence: Synthetic polypeptide

SEQ ID NO: 6454 - protein, 118 aa, Artificial Sequence
  Description of Artificial Sequence: Synthetic polypeptide
QVQLVESGGGVVQPGRSQRLSCAASGFTFSHYGMHWVRQAPGKGLEWVAVISYDGNNKHYADSVKGRFTTSRDNSKNTLFLQMNSLRAEDTAVYYCARGYSGYVLDYWGQGTLVTVSS

SEQ ID NO: 6455 - protein, 121 aa, Artificial Sequence
  Description of Artificial Sequence: Synthetic polypeptide
EVQLVESGPGLVKSSETLSLKCTVSGGSISSSGYYWGWIRQPPGKGLEWIGSIHRSGSTFYNPSLKSRVTISVDTSKSQFSLRLTSVTAADTSVYFCGRHGRDYYYGMDVWGQGTTVTVSS

SEQ ID NO: 6456 - protein, 121 aa, Artificial Sequence
  Description of Artificial Sequence: Synthetic polypeptide
EVQLVQSGPGLVKSSETLSLKCTVSGGSISSSGYYWGWIRQPPGKGLEWIGSIHRSGSTFYNPSLKSRVTISVDTSKSQFSLRLTSVTAADTSVYFCGRHGRDYYYGMDVWGQGTTVTVSS

SEQ ID NO: 6457 - protein, 121 aa, Artificial Sequence
  Description of Artificial Sequence: Synthetic polypeptide
EVQLVESGPGLVKPSETLSLKCTVSGGSIRSSGYYWGWIRQPPGKGLEWIGSIHHSGSTYYNPSLKSRVTISVDTSKSQFSLRLTSVTAADTAVYYCGRHGRDYYYGMDVWGQGTTVTVSS

SEQ ID NO: 6458 - protein, 126 aa, Artificial Sequence
  Description of Artificial Sequence: Synthetic polypeptide
QVQLVESGGGLVQPGGSLRLSCAASGFTFSSYGMSWVRQVPGKGLEWVSAISGSGGSTYYVDSVKGRFTISRDNFKNTLYLQMNSLRVEDTAVYYCAKDVGYCSTTSCRGDAFDVWGQGTMVTVSS

SEQ ID NO: 6459 - protein, 126 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTVYMELRRLRSDDTAVYYCARDGSPTMVTRYYSYGMDVWGQGTLVTVSS

SEQ ID NO: 6460 - protein, 114 aa, Artificial Sequence
  Description of Artificial Sequence: Synthetic polypeptide
KVQLVESGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6461 - protein, 114 aa, Artificial Sequence
  Description of Artificial Sequence: Synthetic polypeptide
QVQLVESGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6462 - protein, 114 aa, Artificial Sequence
  Description of Artificial Sequence: Synthetic polypeptide
EVQLVESGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6463 - protein, 114 aa, Artificial Sequence
  Description of Artificial Sequence: Synthetic polypeptide
QVQLVESGGGLVKPGGSLRLSCAASGFTFSDYYISWIRQAPGKGLEWVSYISSSGSTRYYADSVKGRFTISRDNAKNSLYLQMNSLRAEDTAVYYCVRSGMDVWGQGTTVTVSS

SEQ ID NO: 6464 - protein, 117 aa, Artificial Sequence
  Description of Artificial Sequence: Synthetic polypeptide
QVQLVQSGGDLVQPGRSLRLSCAASGFTFDVYAMHWVRQAPGKGLEWVSGISWNSGYIGYADSVKGRFTISRDNAKNSLYLQMNSLRAEDTALYYCAKDKGIGFDYWGQGTLVTVSS

SEQ ID NO: 6465 - protein, 118 aa, Artificial Sequence
  Description of Artificial Sequence: Synthetic polypeptide
QVQLVESGGGVVQPGRSLRLSCAASGFTFSNYGMHWVRQAPGKGLEWVAVTSYDGSNKHYADSVKGRFSTSRDNPKNTLYLQMDSLRGEDTAVYYCARGYSGFVLDNWGQGTLVTVSS

SEQ ID NO: 6466 - protein, 121 aa, Artificial Sequence
  Description of Artificial Sequence: Synthetic polypeptide
QVQLVESGGGLVQPGGSLRLSCAASGFTFSSYAMSWVRQAPGKGLEWVSAISGSGGSTYYADSVKGRFTISRDNSKNTLYLQMNSLRAEDTAVYYCAKAPYSGYDWYFDYWGQGTLVTVSS

SEQ ID NO: 6467 - protein, 121 aa, Artificial Sequence
  Description of Artificial Sequence: Synthetic polypeptide
QVQLVESGGGVVQPGRSLRLSCAASGFIFSNYGMHWVRQAPGKGLEWVAVIAYDGSSKHYVDSVKGRFTISRDNSKNTLYLQMNSLRAEDTAVYYCAKPIAVARYYGMDVWGQGITVTVSS

SEQ ID NO: 6468 - protein, 114 aa, Artificial Sequence; identical to SEQ ID NO: 6462
  Description of Artificial Sequence: Synthetic polypeptide

SEQ ID NO: 6469 - protein, 121 aa, Artificial Sequence
  Description of Artificial Sequence: Synthetic polypeptide
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCATRSGYSSTWYVDYWGQGTLVTVSS

SEQ ID NO: 6470 - protein, 114 aa, Artificial Sequence
  Description of Artificial Sequence: Synthetic polypeptide
QVQLVESGGGLVQFGGSLKLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6471 - protein, 114 aa, Artificial Sequence
  Description of Artificial Sequence: Synthetic polypeptide
QVQLVESGGGLVQFGGSLRLSCAASGFTFSSYGMNWVRQSPGKGLEWVSAIGGSGGSTYYADSVKGRFTISRDNSKNTLYLQMTSLRAEDTAVYYCAKGAYDVWGQGTTVTVSS

SEQ ID NO: 6472 - protein, 114 aa, Artificial Sequence
  Description of Artificial Sequence: Synthetic polypeptide
QVQLVESGGGLVQFGGSLKLSCAASGFTFSSYGMNWVRQTPGKGLEWVSAIGGSGGSTYYADSVKGRFTISRDNSKNTLYLQMTSLRAEDTAVYYCAKGAYDVWAQGTTVTVSS

SEQ ID NO: 6473 - protein, 121 aa, Artificial Sequence; identical to SEQ ID NO: 6467
  Description of Artificial Sequence: Synthetic polypeptide

SEQ ID NO: 6474 - protein, 114 aa, Artificial Sequence; identical to SEQ ID NO: 6461
  Description of Artificial Sequence: Synthetic polypeptide

SEQ ID NO: 6475 - protein, 120 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYVDSVKGRFTTSRDNSKNTLYLQMNSLRAEDTAMYYCVRGRGTQDPLFDNWGQGTLVTVSS

SEQ ID NO: 6476 - protein, 123 aa, Artificial Sequence
  Description of Artificial Sequence: Synthetic polypeptide
QVQLVESGGGVVQPGRSLTLSCAASGFMFNRFGMHWVRQAPGKGLDWVAVIWYDGSNKYYADSVKGRFTISRDNSKNTLYLQVNSLRAEDTAVYYCAREGTPHYYDSSGLDYWGQGTLVTVSS

SEQ ID NO: 6477 - protein, 114 aa, Artificial Sequence; identical to SEQ ID NO: 6461
  Description of Artificial Sequence: Synthetic polypeptide

SEQ ID NO: 6478 - protein, 132 aa, Artificial Sequence
  Description of Artificial Sequence: Synthetic polypeptide
QVQLVQSGGGVVQPGRSLRLSCAASGFTFSSYGMHWVRQAPGKGLEWVAFISYDGSNKYYADSVKGRLTISRDNSKNMLYLQMNSLRAEDTAVYYCAKGGVVVPGPTRYNWNHYYYYGMDVWGQGTTVTVSS

SEQ ID NO: 6479 - protein, 118 aa, Artificial Sequence
  Description of Artificial Sequence: Synthetic polypeptide
QVQLVQSGGGVVQPGRSLRLSCAASGFTFSSYGMHWVRQAPGKGLEWVAVISYDGSDKKYADSVKGRITISRDNSKNTLYLQMNSLRAEDTAVYYCAKGGSGSSFDYWGQGILVTVSS

SEQ ID NO: 6480 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVISYDGNDKKYADSVKGRFTISRDNSKSTLYLQMNTLRDEDTAIFYCAKGGRGFAFDIWGQGTMVTVSS

SEQ ID NO: 6481 - protein, 117 aa, Artificial Sequence
  Description of Artificial Sequence: Synthetic polypeptide
EVQLVQSGGGVVQPGRSLRLSCAASGFTFSSYGMHWVRQAPGKGLEWVVVIWYDGSNKYYGDSVKGRFTISRDNSKNTLYLQMNSLRAEDTAVYYCARGNYFAFDIWGQGTMVTVSS

SEQ ID NO: 6482 - protein, 121 aa, Artificial Sequence
  Description of Artificial Sequence: Synthetic polypeptide
QVQLVESGGGVVQPGRSLSLSCAASGFTFSNYGMHWVRQAPGKGLEWVAAISYDGNTKYYVDSVKGRFTISRDNSKNTLYLQMNSLRGEDMAVYYCVGARPGYDHYGMDVWGQGTTVTVSS

SEQ ID NO: 6483 - protein, 132 aa, Artificial Sequence
  Description of Artificial Sequence: Synthetic polypeptide
EVQLVESGGGVVQPGRSLRLSCAASGFTFSSYGMHWVRQAPGKGLEWVAFISYDGSNKFYADSVKGRLTISRDNSKNMLYLQMNSLRAEDTAVYYCAKGGVVIPGPTRYNWNHYYYYGMDVWGQGTTVTVSS

SEQ ID NO: 6484 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVTVISYDGSDKYYADSVKGRFTISRDNSKNTLYLQMNSLRAEDTAMYYCVKGGSGWSFDYWGQGTLVTVSS

SEQ ID NO: 6485 - protein, 118 aa, Artificial Sequence
  Description of Artificial Sequence: Synthetic polypeptide
QVQLVESGGGVVQPGRSLRLSCVASGFIFSDYGMHWVRQAPGKGLEWVAVISYDGSDKNYVDSVKGRFTISRDNSKKTQYLQMNSLRAEDTAVYYCAKGGSGWSFDYWGPGTLVTVSS

SEQ ID NO: 6486 - protein, 118 aa, Artificial Sequence
  Description of Artificial Sequence: Synthetic polypeptide
QVQLVESGGGVVQPGRSLRLSCVASGFTFSDYGMHWVRQAPGKGLEWVAVISYDGNNKNYADSVMGRFTISRDNSKKTQYLQMNSLRAEDTAVYYCAKGGSGWSFDYWGPGTLVTVSS

SEQ ID NO: 6487 - protein, 118 aa, Artificial Sequence
  Description of Artificial Sequence: Synthetic polypeptide
EVQLVESGGGVVQPGRSLRLSCAASGFTFSSYGMHWVRQAPGKGLEWVTVISYDGSDKYYADSVKGRFTISRDNSKNTLYLQMNSLRAEDTAMYYCVKGGSGWSFDYWGQGTLVTVSS

SEQ ID NO: 6488 - protein, 118 aa, Artificial Sequence; identical to SEQ ID NO: 6454
  Description of Artificial Sequence: Synthetic polypeptide

SEQ ID NO: 6489 - protein, 124 aa, Artificial Sequence
  Description of Artificial Sequence: Synthetic polypeptide
EVQLVQSGGGLVKPGGSLRLSCTASGFTFSNAWMSWVRQAPGKGLEWVGRIKSKPAGGTTDYAAPVKDRFSISRDDSKTTLYLRMNSLKTEDTAVYYCTTSITTRRGTYYFDYWGQGTLVTVSS

SEQ ID NO: 6490 - protein, 118 aa, Artificial Sequence
  Description of Artificial Sequence: Synthetic polypeptide
EVQLVQSGGGVVQPGRSLRLSCAASGFTFNNYGMHWVRQAPGKGLEWLAVISYDGNDKHYVDSVKGRFTTSRDNSKNTLYLQMNSLRVEDTAVFYCVRGGSGWSFDSWGQGTLVTVSS

SEQ ID NO: 6491 - protein, 118 aa, Artificial Sequence
  Description of Artificial Sequence: Synthetic polypeptide
QVQLVESGGGVVQPGRSLRLSCAASGFTFNNYGMHWVRQAPGKGLEWLAVISYDGNDKHYVDSVKGRFTTSRDNSKNTLYLQMNSLRVEDTAVFYCVRGGSGWSFDSWGQGTLVTVSS

SEQ ID NO: 6492 - protein, 121 aa, Artificial Sequence
  Description of Artificial Sequence: Synthetic polypeptide
EVQLVQSGGGVVQPGRSLRLSCAASGFTFSSYGMHWVRQAPGKGLEWVAVISYAGINKYYADSVKGRFTISRDDSKNTLFLQMNSLRTEDTAVYYCAKRDSGISHDPFDIWGQGTMVTVSS

SEQ ID NO: 6493 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVAVISYQESNKYYVDSVKGRFTISRDNSKNTLYLQMNSLSAEDTAVYYCAQSRGYSYGLGYWGQGTLVTVSS

SEQ ID NO: 6494 - protein, 119 aa, Artificial Sequence
  Description of Artificial Sequence: Synthetic polypeptide
QVQLVQSGGGVVQPGRSLRLSCEASGFTFSSYGMHWVRQAPGKGLEWVAVISYDGSNKHYADSVKGRFTISRDNSKNTLYVQMNSLRAEDTAVYYCAQSRGYSYGLGYWGQGTLVTVSS

SEQ ID NO: 6495 - protein, 119 aa, Artificial Sequence
  Description of Artificial Sequence: Synthetic polypeptide
EVQLVQSGGGVVQPGRSLRLSCAASGFTFSSYGMHWVRQAPGKGLEWVAVISYQESNKHYVDSVKGRFTISRDNSKNTLYLHMNSLRAEDTAVYYCAQSRGYSYGLGYWGQGTLVTVSS

SEQ ID NO: 6496 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVALISYAGSNKHYADSVKGRFTISRDDSKNTLYLQMNSLRVEDTAVYYCAKSRGYSYGLGYWGQGTLVTVSS

SEQ ID NO: 6497 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTLVTVSS

SEQ ID NO: 6498 - protein, 117 aa, Artificial Sequence
  Description of Artificial Sequence: Synthetic polypeptide
EVQLVQSGGGLVQPGGSLRLSCAASGFTFRSYVMSWVRQAPGMGLEWVSAITASGGSTYYGDSVKGRFTISRDNSKNTLYLQMNSLRAEDTAVYYCAKDYYGPFDYWGQGTLVTVSS

SEQ ID NO: 6499 - protein, 124 aa, Artificial Sequence
  Description of Artificial Sequence: Synthetic polypeptide
EVQLVESGGGLVQPGGSLRLSCAASGFTFSIFWMNWVRQAPGKGLEWVAKIKQDGSEKYYVDSMKGRFTISRDNVKNSLYLQMNSLRAEDTAVYYCARGVWGSYRYTSSGLDVWGQGTTVTVSS

SEQ ID NO: 6500 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVALISYVGSNKHYADSVKGRFTISRDNSKNTLYLQMNSLRAEDTAVYYCAKSRGYSYGLDYWGQGTLVTVSS

SEQ ID NO: 6501 - protein, 119 aa, Artificial Sequence
  Description of Artificial Sequence: Synthetic polypeptide
QVQLVQSGGGVVQPGRSLRLSCAASGFSFSSFGMHWVRQAPGKGLEWVAVISYGGINKHYSDSVKGRFTISRDDSKNTLYLQMNSLRAEDTAVYYCAKREGYRYAYDYWGQGTLVTVSS

SEQ ID NO: 6502 - protein, 119 aa, Artificial Sequence; identical to SEQ ID NO: 6497
  Description of Artificial Sequence: Synthetic polypeptide

SEQ ID NO: 6503 - protein, 119 aa, Artificial Sequence
  Description of Artificial Sequence: Synthetic polypeptide
QVQLVESGGGVVQPGRSLRLSCAASGFSFSSFGMHWVRQAPGKGLEWVAVISYGGINKHYSDSVKGRFTISRDDSKNTLYLQMNSLRAEDTAVYYCAKREGYRYAYDYWGQGTLVTVSS

SEQ ID NO: 6504 - protein, 119 aa, Artificial Sequence
  Description of Artificial Sequence: Synthetic polypeptide
EVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTMVTVSS

SEQ ID NO: 6505 - protein, 119 aa, Artificial Sequence
  Description of Artificial Sequence: Synthetic polypeptide
EVQLVESGGGVVQPGRSLRISCAASGFTFSSYGMHWVRHAPGKGLEWVAMISYEGSNRHYVDSVKGRFTISRDNSNNTLYLQMNSLRAEDTAVYFCAKRNSTKGYFDIWGQGTMVTVSS

SEQ ID NO: 6506 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVTVISYDGSNRNYADSVKGRFTISRDNSENTLYLQMNSLRADDTAVYYCAQSRGYSYGLGYWGQGTLVTVSS

SEQ ID NO: 6507 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVALISYAGSNKHYADSVKGRFTISRDDSKNTLYLQMNSLRVEDTAVYYCAKSRGYSYGLGYWGQGTMVTVSS

SEQ ID NO: 6508 - protein, 119 aa, Artificial Sequence
  Description of Artificial Sequence: Synthetic polypeptide
QVQLVQSVGGVVQPGRSLRLSCAASGFTFSSYGMHWVRQAPGKGLEWVALISYAGINEYYADSVKGRFTISRDDSKNTLYLQMNSLRVEDTAVYYCAKSRGYSYGLGYWGQGTLVTVSS

SEQ ID NO: 6509 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVALISYVGSNKHYADSVKGRFTISRDNSKNTLYLQMNSLRAEDTAVYYCAKSRGYSYGLDYWGQGTLVTVSS

SEQ ID NO: 6510 - protein, 117 aa, Artificial Sequence
  Description of Artificial Sequence: Synthetic polypeptide
QVQLVESGAEVKKPGASVKVSCKASGYTFTTYGISWVRQAPGQGLEWMGWISAYNGKTNYAQKFQGRVTMTTDTSTNTAYMELRSLRFDDTAVYYCARDGGTPFYYWGQGTLVTVSS

SEQ ID NO: 6511 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTLVTVSS

SEQ ID NO: 6512 - protein, 122 aa, Artificial Sequence
  Description of Artificial Sequence: Synthetic polypeptide
QVQLVESGGGLVQPGGSLRLSCVASGFTFSSYAMSWVRQAPGKGLEWVSGISGSGGNTYYADSVKGRFTISRDNSENTLYLQMNSLRAEDTAVYHCAKDPHSSRWPGFFDLWGRGTLVTVSS

SEQ ID NO: 6513 - protein, 122 aa, Artificial Sequence
  Description of Artificial Sequence: Synthetic polypeptide
QVQLVQSGGGLVQPGGSLRLSCAASGFTFSNYAMSWVRQAPGKGLEWVSAISGSGDNTYYADSVRGRFTISRDNSKNTLYLQMNSLRAEDTAIYYCAKDPHSSRWPGFFDLWGRGTLVTVSS

SEQ ID NO: 6514 - protein, 121 aa, Artificial Sequence
  Description of Artificial Sequence: Synthetic polypeptide
QVQLQQWGAGLLTPSETLSLTCAVYGGSFSGHYWSWIRQPPGKGLEWIGEINPRGSTNYKPSLKSRVTISVDTSKNQFSLNLRSVTAADTAMYYCAREGNLAARLWFFDLWGRGTLVTVSS

SEQ ID NO: 6515 - protein, 114 aa, Artificial Sequence
  Description of Artificial Sequence: Synthetic polypeptide
QVQLVQSGGGLVQPGGSLRLSCAASGFTFSSYAMNWVRQAPGKGLEWVSTISGSGGSTYYADSVKGRFTFSRDNSKNTLYLQMNNLRAEDTAVYYCAKVGGDVWGQGTTVTVSS

SEQ ID NO: 6516 - protein, 122 aa, Artificial Sequence
  Description of Artificial Sequence: Synthetic polypeptide
QVQLVQSGGGLVQPGGSLRLSCAASGFTFSNYAMSWVRQAPGKGLEWVSAISGSGDNTYYADSVRGRFTISRDNSKNTLYLQMNSLRAEDTAVYYCAKDPHSSRWPGFFDLWGRGTLVTVSS

SEQ ID NO: 6517 - protein, 128 aa, Artificial Sequence
  Description of Artificial Sequence: Synthetic polypeptide
QVQLVQSGGGLVQPGRSLRLSCAASGFTFDDYAMHWVRQTPGKGLEWVSGISWNSGSIGYADSVKGRFTISRDNAKNSLYLQMNSLITEDTALYYCAKDMEYYDILTGYYSYYIMDVWGQGTTVTVSS

SEQ ID NO: 6518 - protein, 113 aa, Artificial Sequence
  Description of Artificial Sequence: Synthetic polypeptide
QVQLVESGGGLVQPGGSLRLSCAASGFTFSSYAMNWVRQAPGKGLEWVSTISGSGGSTYYPDSVKGRFTISRDNSKNTLYLQMNSLKAEDTAVYYCAKVGGDVWGQGTTVMFS

SEQ ID NO: 6519 - protein, 127 aa, Artificial Sequence
  Description of Artificial Sequence: Synthetic polypeptide
QVQLVQSGGGLVKPGGSLRLSCAASGVTFSDYYMNWIRQAPGKGLEWVSYISTSGSIIYYTDSVKGRFTISRDNAKNSLYLQMNSLRAEDTAVYYCAGGVDSDDYEDYYSYYDMDVWGQGTTVTVSS

SEQ ID NO: 6520 - protein, 120 aa, Artificial Sequence
  Description of Artificial Sequence: Synthetic polypeptide
EVQLVQSGGGLVQPGGSLRLSCAASGFTFSSYAMSWVRQAPGKGLEWVSAISGSGDYTYYADSVKGRFTISRDNSKNTLYLQMSSLRAEDTAVYYCAKYSYGLYYYFDLWGRGTLVTVSS

SEQ ID NO: 6521 - protein, 119 aa, Artificial Sequence; identical to SEQ ID NO: 6501
  Description of Artificial Sequence: Synthetic polypeptide

SEQ ID NO: 6522 - protein, 122 aa, Artificial Sequence
  Description of Artificial Sequence: Synthetic polypeptide
QVQLVQSGGGLVKPGGSLRLSCAASGFTFSNAWMSWVRQAPGKGLEWIGRIKSKTDGGTTDYAAPVKGRFTISRDDSKNTLYLQMNSLKTEDTAAYYCFTDDFWSGDYTHCWGQGTLVTVSS

SEQ ID NO: 6523 - protein, 127 aa, Artificial Sequence
  Description of Artificial Sequence: Synthetic polypeptide
EVQLVQSGGGLVKPGGSLTLSCAASGFTFSDYYMNWIRQAPGKGLEWVSYISTGGSTIYYADSVKGRFTISRDNAKNSLYLQMNSLKADDPAVYYCARGVDSDDYEDFYSYYDLDVWGQGTTVTVSS

SEQ ID NO: 6524 - protein, 125 aa, Artificial Sequence
  Description of Artificial Sequence: Synthetic polypeptide
QVQLVQSGAEVKKPGASVKVSCKASGYTFSNYGISWVRQAPGQGLEWMGWINTYNGDTNYAQELQGRVTMTTDTSTNTAYMEMRSLRSDDTAVYYCVRVVVVPADGHYYYGMDVWGQGTTVTVSS

SEQ ID NO: 6525 - protein, 124 aa, Artificial Sequence
  Description of Artificial Sequence: Synthetic polypeptide
QVQLVQSGGGVVQPGRSLRLSCEASGFTISSYGMHWVRQAPGKGLEWVAVIWYDGSNKYYADSVKGRFTISRDKSRNTLYLQMNSLRAEDTAVYYCARDNWNYEDYYYYGMDVWGQGTTVTVSS

SEQ ID NO: 6526 - protein, 127 aa, Artificial Sequence
  Description of Artificial Sequence: Synthetic polypeptide
QVQLVQSGGGLVKPGGSLRLSCAASGFTFSDYYMNWIRQAPGKGLEWVSYISTGGSTIYYADSVKGRFTISRDNAKNSLYLQMNSLRAEDTALYYCARGVDSDDYEDYYSYYDMDVWGQGTTVTVSS

SEQ ID NO: 6527 - protein, 127 aa, Artificial Sequence
  Description of Artificial Sequence: Synthetic polypeptide
EVQLVESGGGLVKPGGSLRLSCAASGFTFSDYYMNWIRQAPGKGLEWVSYISTGGSTIYYADSVKGRFTISRDNAKNSLYLQMNSLRADDTAVYYCARGVDSDDYEDFYSYYDLDVWGQGTTVTVSS

SEQ ID NO: 6528 - protein, 127 aa, Artificial Sequence
  Description of Artificial Sequence: Synthetic polypeptide
QVQLVESGGGLVKPGGSLRLSCAASGFTFSDYYMNWIRQAPGKGLEWVSYISTSGSTIYYADSVKGRFTISRDNAKNSLYLQMNTLRAEDTAVYYCARGVDSSDYEDYYSYYDLDVWGQGTTVTVSS

SEQ ID NO: 6529 - protein, 122 aa, Artificial Sequence
  Description of Artificial Sequence: Synthetic polypeptide
QVQLVQSGGGLVKPGGSLRLSCAASGFTFSDAWMTWVRQAPGKGLEWIGRIKSKTDGGTTDYAAPVKGRFTISRDDSKNTLYLQMNSLKTEDTAAYYCFTDDFWSGDYTHCWGQGTLVTVSS

SEQ ID NO: 6530 - protein, 122 aa, Artificial Sequence; identical to SEQ ID NO: 6529
  Description of Artificial Sequence: Synthetic polypeptide

SEQ ID NO: 6531 - protein, 120 aa, Artificial Sequence
  Description of Artificial Sequence: Synthetic polypeptide
QVQLVESGGDLVQPGGSLRLSCAASGFTFSSYAMSWVRQAPGKGLEWVSAISGSGDYTYYADSVKGRFTISRDNSKNTLYLQMNSLRAEDTAVYYCAKYSYGLYYYFDLWGRGTTVTVSS

SEQ ID NO: 6532 - protein, 119 aa, Artificial Sequence
  Description of Artificial Sequence: Synthetic polypeptide
EVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGTLVTVSS

SEQ ID NO: 6533 - protein, 127 aa, Artificial Sequence
  Description of Artificial Sequence: Synthetic polypeptide
QVQLLQSGGGLVKPGGSLRLSCAASGFTFSDYYMNWIRQAPGKGLEWVSYISTGGSTIYYADSVKGRFTISRDNAKNSLYLQMNSLRADDTAVYYCARGVDSDDYEDFYSYYDLDVWGQGTTVTVSS

SEQ ID NO: 6534 - protein, 127 aa, Artificial Sequence
  Description of Artificial Sequence: Synthetic polypeptide
QVQLVQSGGGLVKPGGSLRLSCAASGFTFSDYYMNWIRQAPGKGLEWVSYISTSGSTIYYADSVKGRFTISRDNAKNSLYLQMTSLRAEDTAVYYCARGVDSSDYEDYYSYYDMDVWGQGTTVTVSS

SEQ ID NO: 6535 - protein, 127 aa, Artificial Sequence; identical to SEQ ID NO: 6526
  Description of Artificial Sequence: Synthetic polypeptide

SEQ ID NO: 6536 - protein, 127 aa, Artificial Sequence
  Description of Artificial Sequence: Synthetic polypeptide
QVQLVQSGGGLVKPGGSLRLSCAASGFTFSDYYMNWIRQAPGKGLEWVSYISTGGTTIYYADSVKGRFTISRDNAKNSLYLQMNSLRADDTAVYYCARGVDSDDYEDFYSYYDLDVWGQGTTVTVSS

SEQ ID NO: 6537 - protein, 122 aa, Artificial Sequence
  Description of Artificial Sequence: Synthetic polypeptide
EVQLVQSGGGLVKPGGSLRLSCAASGFTFSNAWMTWVRQAPGKGLEWVGRIKSKTDGGTTDYAAPVKGRFTISRDDSKNTLYLQMNSLKTEDTAVYYCLTDDFWSEYYTHCWGQGTLVTVSS

SEQ ID NO: 6538 - protein, 127 aa, Artificial Sequence
  Description of Artificial Sequence: Synthetic polypeptide
EVQLVQSGGGLVKPGGSLRLSCAASGVTFSDYYMTWIRQAPGKGLEWVSYISTSGRTIYYADSVKGRFTISRDNAKNSLYLQMNNLRAEDTAVYYCARGVDSDDYEDFYSYYDMDVWGQGTTVTVSS

SEQ ID NO: 6539 - protein, 126 aa, Artificial Sequence
  Description of Artificial Sequence: Synthetic polypeptide
EVQLVQSGGGLVQPGGSLRLSCAASGFTFSSYWMSWVRQAPGKGLEWVANIKQDGSEKYYVDSVKGRFTISRDNAKSSLHLQMNSLRAEDTAVYYCARETVDYYDNSEYSYGMDVWGQGTTVTVSS

SEQ ID NO: 6540 - protein, 127 aa, Artificial Sequence
  Description of Artificial Sequence: Synthetic polypeptide
EVQLVQSGGGLVKPGGSLRLSCAASGFTFSDYYMNWIRQAPGKGLEWVSYISTGGSTIYYADSVKGRFTISRDNAKNSLYLQMNSLRADDTAVYYCARGVDSDDYEDFYSYYDLDVWGQGTTVTVSS

SEQ ID NO: 6541 - protein, 127 aa, Artificial Sequence
  Description of Artificial Sequence: Synthetic polypeptide
EVQLVQSGGGLVKPGGSLRLSCAASGVTFSDYYMNWIRQAPGKGLEWVSYISTSGSIIYYTDSVKGRFTISRDNAKNSLYLQMNSLRAEDTAVYYCAGGVDSDDYEDYYSYYDMDVWGQGTMVTVSS

SEQ ID NO: 6542 - protein, 124 aa, Artificial Sequence
  Description of Artificial Sequence: Synthetic polypeptide
QVQLVQSGGGVVQPGRSLRLSCEASGFTISSYGMHWVRQAPGKGLEWVAAIWYDGNNKYYADSVKGRFTISRDKSRNTLYLQMNSLRAEDTAVYYCARDNWNYEDYYYYGMDVWGQGTTVTVSS

SEQ ID NO: 6543 - protein, 119 aa, Artificial Sequence
  Description of Artificial Sequence: Synthetic polypeptide
EVQLVQSGGGVVQPGRSLRLSCEASGFTFSSYGMHWVRQAPGKGLEWVAVISYDGSNKHYTDSVKGRFTISRDNSKNTLYLQMNSLRAEDTAVYFCAQSRGYSYGLGYWGQGTLVTVSS

SEQ ID NO: 6544 - protein, 120 aa, Artificial Sequence
  Description of Artificial Sequence: Synthetic polypeptide
QVQLVQSGGGVVQPGRSLRLSCAASGFTFSSYGMHWVRQAPGKGLEWVAVISYDGINKYYVDSVKGRFTISRDNSKNTLYLQMNSLRTEDTAVYFCAKGDYGDFDAFDIWGQGTMVTVSS

SEQ ID NO: 6545 - protein, 118 aa, Artificial Sequence
  Description of Artificial Sequence: Synthetic polypeptide
QVQLVQSGGGVVQPGRSLRLSCAASGFTFSSYGIHWVRQAPGKGLEWVAVISYDGSDKKYADSVKGRITISRDNSKNTLYLQMNSLRAEDTAVYYCAKGGSGSSFDYWGQGILVTVSS

SEQ ID NO: 6546 - protein, 114 aa, Artificial Sequence
  Description of Artificial Sequence: Synthetic polypeptide
QVQLVQSGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6547 - protein, 119 aa, Artificial Sequence
  Description of Artificial Sequence: Synthetic polypeptide
QVQLVQSGGGLVQPGGSLRLSCAASGFTLSSYAMSWVRQAPGKGLEWVSTFSGSGIIYYLDSVKGRFTISRDSSKNTLYLQMNSLRVEDTAVFYCAKDRGAAAGAFDYWGQGTLVTVSS

SEQ ID NO: 6548 - protein, 114 aa, Artificial Sequence
  Description of Artificial Sequence: Synthetic polypeptide
KVQLLESGGGLVQFGGSLKLSCAASGFTFTSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6549 - protein, 119 aa, Artificial Sequence
  Description of Artificial Sequence: Synthetic polypeptide
QVQLVQSGGGLVQPGGSLRLSCAASGFTLSSYAMSWVRQAPGKGLEWVSTISGSGIIYYTDSVKGRFTISRDSSKNTVYLQMTSLRVEDTAVYYCAKDRGAAAGAFDYWGQGTLVTVSS

SEQ ID NO: 6550 - protein, 119 aa, Artificial Sequence
  Description of Artificial Sequence: Synthetic polypeptide
QVQLVESGGGLVQPGGSLRLSCAASGFTFSSYDMHWVRQATGKGLEWVSAIGTAGDTYYPGSVKGRFTISRENAYNSLYLQMNSLRAGDTAVYYCAAEYSSSGGAFDIWGQGTMVTVSS

SEQ ID NO: 6551 - protein, 114 aa, Artificial Sequence; identical to SEQ ID NO: 6461
  Description of Artificial Sequence: Synthetic polypeptide

SEQ ID NO: 6552 - protein, 121 aa, Artificial Sequence
  Description of Artificial Sequence: Synthetic polypeptide
QVQLVQSGGGVVQPGRSLRLSCAASGFTFSSYGLHWVRQAPGKGLEWVAVISYDGSNKYYADSVKGRFTISRDNSKNTLYLQMNSLRAEDTAVYYCAKPIAVARYYGMDVWGQGTTVTVSS

SEQ ID NO: 6553 - protein, 118 aa, Artificial Sequence
  Description of Artificial Sequence: Synthetic polypeptide
KVQLVESGGGLVKPGGSLRLSCAASGFTFSDHYMNWIRQAPGKGLEWVSYFSSNVNTIYYTDSVKGRFTISRDNAKNSLYLQMNSLRAEDTAVYYCAKRTPAGPFDYWGQGTLVTVSS

SEQ ID NO: 6554 - protein, 121 aa, Artificial Sequence
  Description of Artificial Sequence: Synthetic polypeptide
EVQLVQSGGGLVQPGGSLKLSCAASGFTFSNYAMSWVRQAPGKGLEWVSAISGDGGNTYYPNSVKGRFTISRDNSKNTLYLQMNSLRAEDTAVYYCAKDYCNSTYYYGEDWGRGTTVTVSS

SEQ ID NO: 6555 - protein, 114 aa, Artificial Sequence
  Description of Artificial Sequence: Synthetic polypeptide
EVQLVQSGGGLVQFGGSLRLSCAASGFTFSSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6556 - protein, 114 aa, Artificial Sequence; identical to SEQ ID NO: 6470
  Description of Artificial Sequence: Synthetic polypeptide

SEQ ID NO: 6557 - protein, 114 aa, Artificial Sequence
  Description of Artificial Sequence: Synthetic polypeptide
EVQLVESGGGLVQFGGSLRLSCAASGFTFTSYGMNWVRQTPGKGLEWVSAIGGSGGSTYYADSVKGRFTISRDNSKNTLYLQMTSLRAEDTAVYYCAKGAYDVWGQGTTVTVSS

SEQ ID NO: 6558 - protein, 113 aa, Artificial Sequence
  Description of Artificial Sequence: Synthetic polypeptide
QVQLVQSGGGLVQPGGSLRLSCAASGFTFSSYAMSWVRQAPGKGLEWVSVINRSGGGTYYADSVKGRFTISRDNSKNALYLQMNSLRTEDTAVYYCAKEVEDWGQGTLVTVSS

SEQ ID NO: 6559 - protein, 114 aa, Artificial Sequence
  Description of Artificial Sequence: Synthetic polypeptide
QVQLVQSGAEVKKPGASVKVSCKASGYTFTSYGVSWVRQAPGQGLEWMGWISAYNGNTNYAQKLQGRVTMTTDTSTSTAYMELTSLRSDDTAVYYCARNWGDYWGQGTLVTVSS

SEQ ID NO: 6560 - protein, 118 aa, Artificial Sequence
  Description of Artificial Sequence: Synthetic polypeptide
QVQLVQSGGGVVQPGRSLRLSCAASGFTFSSYGMHWVRQAPGKGLEWVAVISYDGSNKKYADSVKGRITISRDNSKNTLYLQMNSLRAEDTAVFYCAKGGSGYSFDYWGQGTLVTVSS

SEQ ID NO: 6561 - protein, 118 aa, Artificial Sequence
  Description of Artificial Sequence: Synthetic polypeptide
QVQLVESGGGLVQPGGSLRLSCAASGFTFSSYAMSWVRQAPGKGLEWVSAIMDDGGNTYYADSVKGRFTISRDNSKNMLYLQMNSLRAEDTAVYYCARGQFLMWFDPWGQGTLVTVSS

SEQ ID NO: 6562 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVAVISYEGSNKHYADSVKGRFTISRDNSKNTLYLQMNSLRAEDTAVFYCAQSRGYSYGLGYWGQGTLVTVSS

SEQ ID NO: 6563 - protein, 132 aa, Artificial Sequence
  Description of Artificial Sequence: Synthetic polypeptide
QVQLVQSGGGVVQPGRSLRLSCAASGFTFSSYGMHWVRQAPGKGLEWVAFISYDGSNKFYADSVKGRLTISRDNSKNMLYLQMNSLRAEDTAVYYCAKGGVVIPGPTRYNWNHYYYYGMDVWGQGTTVTVSS

SEQ ID NO: 6564 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSDKKYADSVKGRFTIARDNSKSTLHLQMNSLRVEDTAVFYCVRGGRGFVFDMWGQGTMVTVSS

SEQ ID NO: 6565 - protein, 116 aa, Artificial Sequence
  Description of Artificial Sequence: Synthetic polypeptide
EVQLVQSGGGLVKPGGSLRLSCAASGFTFSNVWMSWVRQAPGQGLEWVGRIKSKIDGGTTDYAAPVKGRFTISRDDSKNTLYLQMNSLKTEDTAVYYCTTGGGTYWGQGTLVTVSS

SEQ ID NO: 6566 - protein, 114 aa, Artificial Sequence
  Description of Artificial Sequence: Synthetic polypeptide
QVQLVESGAEVKKPGASVKVSCKASGYTFTSYGISWVRQAPGQGLEWMGWISGYNGNTKYAQKVQGRVTMTTDASTSTAYMELRSLRSDDTAVYYCARNWGDYWGQGTLVTVSS

SEQ ID NO: 6567 - protein, 116 aa, Artificial Sequence
  Description of Artificial Sequence: Synthetic polypeptide
QVQLVQSGGGLVKPGGSLRLSCAASGFTFSNVWMSWVRQAPGQGLEWVGRIKSKIDGGTTDYAAPVKGRFFISRDDSKNTLYLQMNSLKTEDTAVYYCTTGGGTYWGQGTLVTVSS

SEQ ID NO: 6568 - protein, 122 aa, Artificial Sequence
  Description of Artificial Sequence: Synthetic polypeptide
QVQLVQSGTDVKKPGASLKVSCEVSGYTFANYGLSWVRQAPGQGLEWMGWIIAYTTNTNYAQKLQDRVTITTDTSTSTAYMELRSLRSDDTAVYYCARVFSGTNHLNYFDYWGQGTLVTVSS

SEQ ID NO: 6569 - protein, 117 aa, Artificial Sequence
  Description of Artificial Sequence: Synthetic polypeptide
QVQLVQSGGGLVQPGGSLRLSCAASGFTFSSYVMSWVRQTPGKGLEWVSAIRTSGGGTYYADSVKGRFTISRDNSKSTLYLQMNSLRAEDSAVYYCAKDGYGAFDYWGQGTLVTVSS

SEQ ID NO: 6570 - protein, 120 aa, Artificial Sequence
  Description of Artificial Sequence: Synthetic polypeptide
QVQLVQSGADVNKPGASLKVSCAASGYTFTNYDINWVPQATGQGLEWMGWMNPTSGNTCYSHKFQGRVTMTRSTSISTAYMELSSLRSEDTAVYYCARDIVGALDAFDIWGQGTMVTVSS

SEQ ID NO: 6571 - protein, 120 aa, Artificial Sequence
  Description of Artificial Sequence: Synthetic polypeptide
QVQLVQSGGGLVQPGGSLRLSCAASGFTFSSYAMSWVRQGPGKGLEWVSVISGSGGSTYYADSVKGRFTISRDNSKNTLYLQMNSLRAEDTAVYYCAKHITGIADGMDVWGQGTTVTVSS

SEQ ID NO: 6572 - protein, 117 aa, Artificial Sequence
  Description of Artificial Sequence: Synthetic polypeptide
QVQLVESGAGVINPGASLILSCAASGYTFTSYHIHWVRQAPGQGLEWMGWINHNGGDKNYAHYFQGRVTLTRDTSNTTLYLELNRLRSDDTAVYYCAKDGIGNFDYWGQGTLVTVSS

SEQ ID NO: 6573 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSDKKYADSVKGRFTIARDNSKSTLHLQMNSLRVEDTAVFYCARGGRGFVFDMWGQGTMVTVSS

SEQ ID NO: 6574 - protein, 132 aa, Artificial Sequence
  Description of Artificial Sequence: Synthetic polypeptide
QVQLVQSGGGVVQPGRSLRLSCAASGFTFSSYGMHWVRQAPGKGLEWAAFISYDGSNKFYADSVKGRLTISRDNSKNILYLQMNSLRAEDTAVYYCAKGGVVVPGPTRYNWNHYYYYGMDVWGQGTTVTVSS

SEQ ID NO: 6575 - protein, 132 aa, Artificial Sequence; identical to SEQ ID NO: 6483
  Description of Artificial Sequence: Synthetic polypeptide

SEQ ID NO: 6576 - protein, 132 aa, Artificial Sequence
  Description of Artificial Sequence: Synthetic polypeptide
QVQLVESGGGVVQPGRSLRLSCAASGFTFSSYGMHWVRQAPGKGLEWVAFISYDGGNKFYADSVKGRLTISRDNSKNILYLQMNSLTAEDTAVYYCAKGGVVVPGPTRYNWNHYYYYGMDVWGQGTTVTVSS

SEQ ID NO: 6577 - protein, 118 aa, Artificial Sequence
  Description of Artificial Sequence: Synthetic polypeptide
QVQLVQSGGGVVQPGRSLRLSCAASGFTFSNYGMHWVRQAPGKGLEWLAVISYDGSNKHYVDSVKGRFTISRDNSKNTLYLQMNSLRTEDTAVHYCVRGGSGWSFDSWGQGTLVTVSS

SEQ ID NO: 6578 - protein, 118 aa, Artificial Sequence
  Description of Artificial Sequence: Synthetic polypeptide
QVQLVESGGGVVQPGRSLRLSCAASGFTFSDYGMHWVRQAPGKGLEWVSVISYDGTNKYYADSVKGRFTISRDNSKNTLYLQMSSLRPEDTAVYYCPKGGSGWSFDYWGQGTLVTVSS

SEQ ID NO: 6579 - protein, 118 aa, Artificial Sequence
  Description of Artificial Sequence: Synthetic polypeptide
QVQLVQSGGGVVQPGRSLRLSCAASGFTFSNYGMHWVRQAPGQGLEWLAVISYDGNNKHYVDSVKGRFTISRDNSKSTLFLQMNSLRTEDTTVYYCARGGSGWSFDSWGQGTLVTVSS

SEQ ID NO: 6580 - protein, 117 aa, Artificial Sequence
  Description of Artificial Sequence: Synthetic polypeptide
QVQLVESGGGVVQPGRSLRLSCAASGFTFNDYGMHWFRQAPGKGLEWLAVISYDGNDKQYEDSVKGRFTISRDNSKNTLFLQMTSLRAEDTAMYFCARGGSGWTFDSWGQGTLVTSP

SEQ ID NO: 6581 - protein, 116 aa, Artificial Sequence
  Description of Artificial Sequence: Synthetic polypeptide
EVQLVQSGGGLVKPGGSLRLSCAASGFTFSDYYMSWIRQAPGKGLEWVSCITSSGSTKKHADSVKGRFTISRDNAKNSLYLQMNSLRAEDTAVYYCARVSRGFDHWGQGTLVTVSS

SEQ ID NO: 6582 - protein, 116 aa, Artificial Sequence
  Description of Artificial Sequence: Synthetic polypeptide
QVQLVESGGGLVKPGGSLRLSCAASGFTFSDYYMSWIRQAPGKGLEWVSCITSSGGTKKYADSVKGRFTISRDNAENSLYLQMNSLRAEDTAVYYCARVSRGFDHWGQGTLVTVSS

SEQ ID NO: 6583 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVISYEGSNKHYADSVKGRFTISRDNSKNTLYLQMNSLRAEDTAVFYCAQSRGYSYGLGYWGQGTLVTVSS

SEQ ID NO: 6584 - protein, 118 aa, Artificial Sequence
  Description of Artificial Sequence: Synthetic polypeptide
QVQLVESGGGVVQPGRSLRLSCAASGFTFSSYGMHWVRQAPGKGLEWLAVISYDGTNKHYVDSVKGRFTISRDNSKNTVYLQMNSLRAEDTALYYCARGGSGWSFDSWGQGTLVTVSS

SEQ ID NO: 6585 - protein, 118 aa, Artificial Sequence
  Description of Artificial Sequence: Synthetic polypeptide
QVQLVQSGGGVVQPGRSLRLSCVASGFTFNNYGLHWFRQAPGKGLEWLAVISYDGNDKHYVDYVKGRFTISRDNSRYTLNLQMNSLRTEDTALYYCARGGSGWSFDSWGQGTLVTVSS

SEQ ID NO: 6586 - protein, 126 aa, Artificial Sequence
  Description of Artificial Sequence: Synthetic polypeptide
QVQLVESGGGVVQPGRSLKLSCAASGFTFSSYGMHWVRQAPGKGLEWVAVIWYDGSNKYYADSVKGRFTISRDNSKNTLYLQMNSLRAEDTAVYYCARDEGRGFGTYYYYYGMDVWGQGTTVTVSS

SEQ ID NO: 6587 - protein, 118 aa, Artificial Sequence
  Description of Artificial Sequence: Synthetic polypeptide
EVQLVESGGGVVQPGRSLRLSCAASGFTFRSYGMHWVRQAPGKGLEWLAVTSYDGNSQHYVDSVKGRFTISRDNSKNTLYLQMNSLRAEDTAVFYCARGGSGWSFDSWGQGTLVTVSS

SEQ ID NO: 6588 - protein, 118 aa, Artificial Sequence
  Description of Artificial Sequence: Synthetic polypeptide
EVQLVESGGGVVQPGRSLRLSCAASGFTFSSYGIHWVRQAPGKGLEWLAVISYDGSNKHYVDSVKGRLTISRDNSKNTLYLQMNSLRAEDTAVYYCARGGRGWSFDSWGQGTTVTVSS

SEQ ID NO: 6589 - protein, 118 aa, Artificial Sequence
  Description of Artificial Sequence: Synthetic polypeptide
QVQLVQSGGGVVQPGRSLRLSCAASGFTFSNYGMHWVRQAPGKGLEWLAVISYDGSNKHYVDSVKGRFTISRDNSKNTLYLQMNSLRAEDTAVHYCVRGGSGWSFDSWGQGTLVTVSS

SEQ ID NO: 6590 - protein, 118 aa, Artificial Sequence
  Description of Artificial Sequence: Synthetic polypeptide
EVQLLESGGGVVQPGRSLRLSCAASGFTFSYHGMHWVRQAPGKGLEWLAVISYDGSDRHYIDSVKGRFTNARDNSKNTLYLQMNSLRPEDTAVYYCARGGSGWSFDSWGQGTLVTVSS

SEQ ID NO: 6591 - protein, 118 aa, Artificial Sequence
  Description of Artificial Sequence: Synthetic polypeptide
QVQLVQSGGGVVQPGRSLKLSCAASGFTFNNYGMHWVRQAPGKGLEWLAVISYDGNDKHYVDSVKGRFTTSKDNSKNTLYLQMNSLRVEDTAVFYCVRGGSGWSFDSWGQGTPVTVSS

SEQ ID NO: 6592 - protein, 118 aa, Artificial Sequence
  Description of Artificial Sequence: Synthetic polypeptide
QVQLVESGGGVVQPGGSLRLSCAASGFTFSSYGMHWVRQAPGKGLEWVAVISYDGSNKNYADSVKGRFTIFRDNSKNTLYLLMNTLRAEDTAVYYCAERGSGWSFDYWGQGTLVTVSS

SEQ ID NO: 6593 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVISYQESNKHYVDSVKGRFTISRDNSKNTLYLQMNSLRAEDTAVYYCAQSRGYSYGLGYWGQGTLVTVSS

SEQ ID NO: 6594 - protein, 119 aa, Artificial Sequence
  Description of Artificial Sequence: Synthetic polypeptide
QVQLVESGGGVVQPGRSLRLSCAASGFTFSSYGMHWVRQAPGKGLEWVAVISYQESNKHYVDSVKGRFTISRDNSKNTLFLQMNSLRAEDTAVYYCAQSRGYSFGLGYWGQGTRSTVSS

SEQ ID NO: 6595 - protein, 119 aa, Artificial Sequence
  Description of Artificial Sequence: Synthetic polypeptide
EVQLVQSGGGVVQPGRSLRLSCAASGFSFSSYGMHWVRQAPGRGLEWVAVISYVGINKYYGDSVKGRFTISRDDSKNTLYLQMNSLRAEDTAVYYCAKSRGYSYGLVYWGQGTLVTVSS

SEQ ID NO: 6596 - protein, 119 aa, Artificial Sequence
  Description of Artificial Sequence: Synthetic polypeptide
QVQLVQSGGGVVQPGRSLRLSCVASGIIFSSYGMHWVRQAPGKGLEWVAVIAYDGSNKNYVDSVKGRFTISRDNSKNTLYLQMNSLRAEDTAVYYCAKSRGYSYGLVYWGQGTMVTVSS

SEQ ID NO: 6597 - protein, 118 aa, Artificial Sequence
  Description of Artificial Sequence: Synthetic polypeptide
QVQLVQSGGGVVQPGRSLRLSCAASGFTFSSYGMHWVRQAPGKGLEWVAVISYQESNKHYVDSVKGRFTISRDNSKNTLYLQMNSLRAEDTAVYYCAKSRGYSYGLGYWGQGPGHVSS

SEQ ID NO: 6598 - protein, 119 aa, Artificial Sequence
  Description of Artificial Sequence: Synthetic polypeptide
EVQLVESGGGVVQPGRSLRLSCAASGFTFSSYGMHWVRQAPGKGLEWVAVISYDGSNKHYTDSVKGRFTISRDNSKNTLYLQMNSLRVEDTAVYYCAQSRGYSYGLGYWGQGTLVTVSS

SEQ ID NO: 6599 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVAVISYQESNKHYLDSVKGRFTISRDNSKNTLYLQMNSLRAEDTAVYYCAKSRGYSYGLGYWGQGTLVTVSS

SEQ ID NO: 6600 - protein, 122 aa, Artificial Sequence
  Description of Artificial Sequence: Synthetic polypeptide
EVQLVQSGGGLVQPGGSLRLSCAASGFTFSSYAMSWVRQAPGKGLEWVSAISGSGGNTYYADSVKGRFTISRDNSKNTLYLQMNSLRAEDTAVYYCAKDPHSSNWPGFFDLWGRGTLVTVSS

SEQ ID NO: 6601 - protein, 118 aa, Artificial Sequence
  Description of Artificial Sequence: Synthetic polypeptide
QVQLVESGGGLVQPGRSLRISCVASGFSFDDYAMHWVRQAPGKGLEWVSGISWISGRIGYADSVKGRFTISRDNAKKSLYLQMNSLRTEDTALYYCVKDDNSSLGDYWGQGTLVTVSS

SEQ ID NO: 6602 - protein, 115 aa, Artificial Sequence
  Description of Artificial Sequence: Synthetic polypeptide
QVQLQESGPGLVKPSETLSLTCTVSGGSISGYYWSRIRQPPGKGLEWIGYIYYSGNTNYDPSLKSRVTISVDTSKNQFSLKLRSVTAADTAVYHCARLGRAFDIWGQGTMVTVSS

SEQ ID NO: 6603 - protein, 114 aa, Artificial Sequence
  Description of Artificial Sequence: Synthetic polypeptide
EVQLVESGGGLVQPGGSLRLSCAASGFTFSSYAMNWVRQAPGKGLEWVSTISGSSGSTYYADSVKGRFTISRDNSKNTLYLQMNSLTAEDTAVYYCAKVGGDVWGQGTTVTVSS

SEQ ID NO: 6604 - protein, 119 aa, Artificial Sequence
  Description of Artificial Sequence: Synthetic polypeptide
QVQLVQSGGGVVQPGRSLRLSCAASGFTFSSYGMHWVRQAPGKGLEWVALISYAGINEYYADSVKGRFTISRDDSKNTLYLQMNSLRVEDTAVYYCAKSRGYSYGLGYWGQGTLVTVSS

SEQ ID NO: 6605 - protein, 118 aa, Artificial Sequence
  Description of Artificial Sequence: Synthetic polypeptide
QVQLVESGGTLVQPGRSLRLSCAASGFTFDDYAMHWVRQAPGKGLEWVSGISWIGGRIGYADSVKGRFTISRDNAKNSLYLQMNSLRAEDTALYYCVKDDNSSLGDYWGQGTLVTVSS

SEQ ID NO: 6606 - protein, 118 aa, Artificial Sequence
  Description of Artificial Sequence: Synthetic polypeptide
QVQLVESGGGLVQPGRSLRLSCAASGFTFDDYAMHWVRQAPGKGLEWVSGISWKSGRIGYADSVKGRFTISRDNAKNSLYLQMNSLRPEDTALYYCAKDDGSSLGDYWGQGTLVTVSS

SEQ ID NO: 6607 - protein, 120 aa, Artificial Sequence
  Description of Artificial Sequence: Synthetic polypeptide
QVQLVQSGGGVVQPGRSLRLSCAASGFTFSSYGMHWVRQAPGKGLEWVAIISYDGINKYYVDSVKGRFTISRDNSKNTLYLQMNSLRAEDTAVYFCAKGDYGDFDAFDIWGQGTMVTVSS

SEQ ID NO: 6608 - protein, 123 aa, Artificial Sequence
  Description of Artificial Sequence: Synthetic polypeptide
EVQLVQSGGGLVKPGGSLRLSCAASGFTFSDAWMTWVRQAPGKGLEWIGRIKSKTDGGTTDYAAPVKGRFTISRDDSKNTLYLQMNSLKTEDTAAYYCFTDDFWSGDYTHCWGQGTLVTVSSS

SEQ ID NO: 6609 - protein, 119 aa, Artificial Sequence; identical to SEQ ID NO: 6593
  Description of Artificial Sequence: Synthetic polypeptide

SEQ ID NO: 6610 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVISYDGNNKHFADSVKGRFTISRDNSKNTLNLQMNSLRAEDRAVYYCARGASGFVLDIWGQGTMVTVSS

SEQ ID NO: 6611 - protein, 128 aa, Artificial Sequence
  Description of Artificial Sequence: Synthetic polypeptide
EVQLVQSGGGLVQPGRSLRLSCAASGFTFDDYAMHWVRQAPGKGLEWVSGISWNSGSIGYADSVKGRFTSSRDNAKNSLYLQMNSLRAEDTALYYCAKDMEYYDILTGYYSYYIMDVWGQGTTVTVSS

SEQ ID NO: 6612 - protein, 121 aa, Artificial Sequence
  Description of Artificial Sequence: Synthetic polypeptide
QVQLQQWGAGLLKPSETLSLTCAVYGGSFSGHYWSWIRQPPGKGLEWIGEINHRGSTNYNPSLKSRATISVDTSKNQFSLKLSSVTAADTAVYYCAREGSLAARLWFFDLWGRDTLVTVSS

SEQ ID NO: 6613 - DNA, 356 bp, Artificial Sequence
  Description of Artificial Sequence: Synthetic polynucleotide
caggtgcagctggtggagtcggggggaggcgtggtccagcctgggaggtccctgagactctcctgtgcagcctctggattcaccttcagtagctatggcatgcactgggtccgccaggctccaggcaaggggctggagtgggtggctcttatatcatatgttggaagtaataaacactatcagactccgtgaagggccgattcaccatttccagagacaattccaaaaacacgctgtatctgcaaatgaacagcctgagagctgaggacacggctgtgtattactgtgcgaaaagtcgtggatacagctatggtctagactactggggccagggaaccctggtcaccgtctcctca

SEQ ID NO: 6614 - protein, 126 aa, Artificial Sequence
  Description of Artificial Sequence: Synthetic polypeptide
EVQLVESGGGLVQPGGSLRLSCAASGFTFSSYGMSWVRQVPGKGLEWVSAISGSGGSTYYVDSVKGRFTISRDNFKNTLYLQMNSLRVEDTAVYYCAKDVGYCSTTSCRGDAFDVWGQGTMVTVSS

SEQ ID NO: 6615 - protein, 122 aa, Artificial Sequence; identical to SEQ ID NO: 6513
  Description of Artificial Sequence: Synthetic polypeptide

SEQ ID NO: 6616 - protein, 122 aa, Artificial Sequence
  Description of Artificial Sequence: Synthetic polypeptide
EVQLVESGGGLVQPGGSLRLSCAASGFTFSNYAMSWVRQAPGKGLEWVSAISGSGDNTYYADSVRGRFTISRDNSKNTLYLQMNSLRAEDTAIYYCAKDPHSSRWPGFFDLWGRGTLVTVSS

SEQ ID NO: 6617 - protein, 121 aa, Artificial Sequence; identical to SEQ ID NO: 6514
  Description of Artificial Sequence: Synthetic polypeptide

SEQ ID NO: 6618 - protein, 121 aa, Artificial Sequence
  Description of Artificial Sequence: Synthetic polypeptide
  MOD_RES (7)..(7): Any amino acid
QVQLQQXGAGLLKPSETLSLTCAVYGGSFSGHYWSWIRQPPGKGLEWIGEINHRGSTNYNPSLKSRATISVDTSKNQFSLKLSSVTAADTAVYYCAREGSLAARLWFFDLWGRDTLVTVSS

SEQ ID NO: 6619 - protein, 121 aa, Artificial Sequence
  Description of Artificial Sequence: Synthetic polypeptide
QVQLQQWGAGLLKPSETLSLTCAVYGGSFSGHYWTWIRQPPGKGLEWIGEINHRGNTNYNPSLKSRATISVDTSKNQFSLKLSSVTAADTAVYYCAREGSLAARLWFFDLWGRDTPVTVSS

SEQ ID NO: 6620 - protein, 121 aa, Artificial Sequence
  Description of Artificial Sequence: Synthetic polypeptide
QLQLQESGPGLVKSSETLSLKCTVSGGSISSSGYYWGWIRQPPGKGLEWIGSIHRSGSTFYNPSLKSRVTISVDTSKSQFSLRLTSVTAADTSVYFCGRHGRDYYYGMDVWGQGTTVTVSS

SEQ ID NO: 6621 - protein, 114 aa, Artificial Sequence; identical to SEQ ID NO: 6559
  Description of Artificial Sequence: Synthetic polypeptide

SEQ ID NO: 6622 - protein, 117 aa, Artificial Sequence
  Description of Artificial Sequence: Synthetic polypeptide
QVQLVESGGGVVQPGRSLRLSCAASGFTFSNYGMHWVRQAPGKGLEWVAAIWFDGSNKKYVDSVKGRFTISRDNSKNTLYLQMNSLRAGDTAVYYCTRDRSGSFDYWGQGTLVTVSS

SEQ ID NO: 6623 - protein, 118 aa, Artificial Sequence
  Description of Artificial Sequence: Synthetic polypeptide
QVQVVESGGGVVQPGRSLRLSCAASGFTFSNYGMHWVRQAPGKGLEWVTVISYDGSNKNYADSVKGRFTISRDNSKNTLYLQMNSLRAEDTAMYYCARGGSGFAFDIWGQGTMVTVSS

SEQ ID NO: 6624 - protein, 128 aa, Artificial Sequence
  Description of Artificial Sequence: Synthetic polypeptide
QVQLVESGGGLVQPGRSLRLSCAASGFTFDDYAMHWVRQVPGKGLEWVSGINWNSGSIGYADSVKGRFTISRDNAKNSLFLQMNSLRAEDTALYYCAKDIEYYDILTGYYSYYIMDVWGQGTTVTVSS

SEQ ID NO: 6625 - protein, 118 aa, Artificial Sequence
  Description of Artificial Sequence: Synthetic polypeptide
QVQLVESGGGVVQPERSLRLSCAASGFTFSSYGMHWVRQAPGEGLEWVAVISYDGSNTKYADSVRGRFTISRDNSKNMLYLQMNSLRAEDTAVFYCARGYSGYAFDYWGQGILVTVSS

SEQ ID NO: 6626 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVISYDGNNKYYADSVKGRFTISRDNSKNTLYLQMNSLRAEDTAVYYCAKGSAGYALDYWGQGTLVTVSS

SEQ ID NO: 6627 - protein, 128 aa, Artificial Sequence
  Description of Artificial Sequence: Synthetic polypeptide
EVQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIEYYDILTGYYSYYIMDVWGQGTTVTVSS

SEQ ID NO: 6628 - protein, 120 aa, Artificial Sequence
  Description of Artificial Sequence: Synthetic polypeptide
EVQLVESGGGLVKPGGSLRLSCAASGFTFSSYTIHWVRQAPGKGLEWVSSISSSSSYIYYVDSVKGRFTISRDNAKNSVYLQMNSLRAEDTAVYYCATSSITARGYFDYWGQGTLVTVSS

SEQ ID NO: 6629 - protein, 118 aa, Artificial Sequence; identical to SEQ ID NO: 6610
  Description of Artificial Sequence: Synthetic polypeptide

SEQ ID NO: 6630 - protein, 128 aa, Artificial Sequence
  Description of Artificial Sequence: Synthetic polypeptide
EVQLVQSGGGVVQPGRSLRLSCTASGFTFSVYGIHWVRQAPGKGLEWVAVIWYDGSNKYYTDSVKGRFTISRDNSKNTLYLQMNSLRAEDTALYYCAREGDLSSSSGSGGYHYVVDVWGQGTMVTVSS

SEQ ID NO: 6631 - protein, 124 aa, Artificial Sequence; identical to SEQ ID NO: 6499
  Description of Artificial Sequence: Synthetic polypeptide

SEQ ID NO: 6632 - protein, 128 aa, Artificial Sequence
  Description of Artificial Sequence: Synthetic polypeptide
QVQLVESGGGVVQPGRSLRLSCTASGFTFSVYGIHWVRQAPGKGLEWVAVIWYDGSNKYYTDSVKGRFTISRDNSKNTLYLQMNSLRAEDTALYYCAREGDLSSSSGSGGYHYVVDVWGQGTTVTVSS

SEQ ID NO: 6633 - protein, 119 aa, Artificial Sequence
  Description of Artificial Sequence: Synthetic polypeptide
EVQLVESGGGLVQPGGSLRLSCAASGFTLSSYAMSWVRQAPGKGLEWVSTISGSGIIYYTDSVKGRFTISRDSSKNTLYLQMNSLRVEDTAVYYCAKDRGAAAGAFDYWGQGTLVTVSS

SEQ ID NO: 6634 - protein, 121 aa, Artificial Sequence
  Description of Artificial Sequence: Synthetic polypeptide
QVQLQQWGAGLLKPSETLSLTCAVYGGSFSGHYWTWIRQPPGKGLEWIGEINHRGNTNYNPSLKSRATISVDTSKNQFSLKLSSVTAADTAVYYCAREGSLAARLWFFDLWGRDTLVTVSS

SEQ ID NO: 6635 - protein, 117 aa, Artificial Sequence
  Description of Artificial Sequence: Synthetic polypeptide
QVQLVQSGAEVKKPGASVKVSCKASGYTFTTYGISWVRQAPGQGLEWMGWISAYNGKTNYAQKFQGRVTMTTDTSTNTAYMELRSLRFDDTAVYYCARDGGTPFYYWGQGTLVTVSS

SEQ ID NO: 6636 - protein, 117 aa, Artificial Sequence; identical to SEQ ID NO: 6622
  Description of Artificial Sequence: Synthetic polypeptide

SEQ ID NO: 6637 - protein, 127 aa, Artificial Sequence
  Description of Artificial Sequence: Synthetic polypeptide
EVQLVESGGGLVKPGGSLRLSCAASGVTFSDYYMTWIRQAPGKGLEWVSYISTDGRTIYYADSVKGRFTISRDNAKNSLYLQMNNLRAEDTAVYYCARGVDSDDYEDFYSYYDMDVWGQGTTVTVSS

SEQ ID NO: 6638 - protein, 127 aa, Artificial Sequence
  Description of Artificial Sequence: Synthetic polypeptide
QVQLVESGGGLVKPGGSLRLSCAASGVTFSDYYMTWIRQAPGKGLEWVSYISTDGRTIYYADSVKGRFTISRDNAKNSLYLQMNNLRAEDTAVYYCARGVDSDDYEDFYSYYDMDVWGQGTTVTVSS

SEQ ID NO: 6639 - protein, 119 aa, Artificial Sequence
  Description of Artificial Sequence: Synthetic polypeptide
QVQLVESGGGLVQPGGSLRLSCAASGFTLSSYAMSWVRQAPGKGLEWVSTISGSGIIYYTDSVKGRFTISRDSSKNTLYLQMNSLRVEDTAVYYCAKDRGAAAGAFDYWGQGTLVTVSS

SEQ ID NO: 6640 - protein, 115 aa, Artificial Sequence
  Description of Artificial Sequence: Synthetic polypeptide
QVQLVQSGAEVKKPGSSVKVSCKASGYTFTDFYINWVRQAPGQGLEWIGEIYPYSGHAYYNEKFKARVTITADKSTSTAYMELSSLRSEDTAVYYCARWDFLDYWGQGTTVTVSS

SEQ ID NO: 6641 - protein, 115 aa, Artificial Sequence; identical to SEQ ID NO: 6640
  Description of Artificial Sequence: Synthetic polypeptide

SEQ ID NO: 6642 - protein, 115 aa, Artificial Sequence; identical to SEQ ID NO: 6640
  Description of Artificial Sequence: Synthetic polypeptide

SEQ ID NO: 6643 - protein, 118 aa, Artificial Sequence [sequence omitted]

SEQ ID NO: 6644 - protein, 128 aa, Artificial Sequence
  Description of Artificial Sequence: Synthetic polypeptide
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTV

SEQ ID NO: 6645 - protein, 137 aa, Artificial Sequence
  Description of Artificial Sequence: Synthetic polypeptide
MKCSWVIFFLMAVVTGVNSEVQLQQSGAELVKPGASVKLSCTASGFNIKDTYIHWVKQRPEQGLEWVGRIDPATGNTRYDPKFQGKATITADTSSNTAYLQLSSLTSEDTAVYYCASFRPGYALDYWGQGTSVTVSS

SEQ ID NO: 6646 - protein, 138 aa, Artificial Sequence
  Description of Artificial Sequence: Synthetic polypeptide
MGWSYIILFLVATATDVHSQVQLQQPGAELVKPGASVKLSCKASGYSFTSYWMHWLKQRPGQGLEWIGEINPNNGRTYYNEKFKTKATLTVDKSSSTAYMQLNSLTSEDSAVYYCARRLTMVESFAYWGQGTLVTFSA

SEQ ID NO: 6647 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDSVKGRFTISRDNSKNTLFLQMDSLRAEDTGVYYCARGGVYKGYFDEWGQGTPVTVSS

SEQ ID NO: 6648 - protein, 119 aa, Artificial Sequence
  Description of Artificial Sequence: Synthetic polypeptide
EVQLVESGGGVVQPGRSLRLSCAASGFIFSKYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 6649 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTAVYYCARGGVYKGYFDVWGQGTPVTVSS

SEQ ID NO: 6650 - protein, 119 aa, Artificial Sequence
  Description of Artificial Sequence: Synthetic polypeptide
EVQLVESGGGVVQPGRSLRLSCAASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 6651 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSS

SEQ ID NO: 6652 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTTVTVSS

SEQ ID NO: 6653 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDVWGQGTPVTVSS

SEQ ID NO: 6654 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDSVKGRFTISRDNSKNTLFLQMDSLRPEDTGVYYCARGGVYKGYFDVWGQGTPVTVSS

SEQ ID NO: 6655 - protein, 119 aa, Artificial Sequence
  Description of Artificial Sequence: Synthetic polypeptide
QVTLKESGPGILQPSQTLSLTCSFSGFSLRKSVMGVSWIRQPSGKGLEWLAHIYWDDDKYYNPSLKSRLTISKDPSRNQVFLKITSVDTADAATYYCTRRGIRSAMDYWGQGTSVTVSS

SEQ ID NO: 6656 - protein, 120 aa, Artificial Sequence
  Description of Artificial Sequence: Synthetic polypeptide
QVTLKESGPGILKPSQTLSLTCSFSGFSLSTSGMGVSWIRQPSGKGLEWLAHIWWDGDNYYNPSLKSQLTISKDTSRNQVFLRIATVDTADTATYYCARRTRVNYAMDYWGQGTSVTVSS

SEQ ID NO: 6657 - protein, 117 aa, Artificial Sequence
  Description of Artificial Sequence: Synthetic polypeptide
QVQLQQSGAELMKPGASVKISCKATGYTFSSYWIEWVKQRPGHGLEWIGDILPGSGSTNYNEKFKDKATFTADTSFNTAYMQLSSLTSEDSAVYYCATRRFRGLDYWGQGTTLTVSS

SEQ ID NO: 6658 - protein, 117 aa, Artificial Sequence
  Description of Artificial Sequence: Synthetic polypeptide
QVQLQQSGAELMKPGASVKISCKATGYTFNDYWIEWVKQRPGHGLEWIGGFSHGSGSTNYNEKFKGKATFTADSSSNTAYMQLSSLTSEDSAVYYCARRRFRGMDYWGQGTSVTVSS

SEQ ID NO: 6659 - protein, 117 aa, Artificial Sequence
  Description of Artificial Sequence: Synthetic polypeptide
QIQLVQSGPELKKPGETVKISCKASGYSFTDYSMHWVKQAPGKGLKWMDWINTETGEPTYADDFKGRFAFSLETSASTAYLQINNLKNEDTATYFCSRRRYRAFDYWGQGTTLTVSS

SEQ ID NO: 6660 - protein, 112 aa, Artificial Sequence
  Description of Artificial Sequence: Synthetic polypeptide
EVKLVESGGGLVQPGGSRKLSCAASGFTFSDYGMVWVRQAPGKGLEWVASISSGSSNIYYADTVKGRFTISRDDPNNTLFLQMRSLRSEDTAMYYCARNPYWGQGTTLTVSS

SEQ ID NO: 6661 - protein, 117 aa, Artificial Sequence
  Description of Artificial Sequence: Synthetic polypeptide
EVKLVESGGGLVQPGGSRKLSCAASGFTFSDYGMVWVRQAPGKGLEWVAYISSGSSTIHYADTMKGRFTISRDNPKNTLFLQMSSLRSEDTAMYYCARRHYYAMDYWGQGTSVTVSS

SEQ ID NO: 6662 - protein, 122 aa, Artificial Sequence
  Description of Artificial Sequence: Synthetic polypeptide
EVQLQQSGADLEKPGASVKLSCTASGFNIKDTFMHWVKQRPEQGLEWIGRIDPANGHTKYDPKFQGKATITADTSSNTAYLQLSSLTSEDTAVYYCARWGQFGLLWNAMDYWGQGTSVTVSS

SEQ ID NO: 6663 - protein, 120 aa, Artificial Sequence
  Description of Artificial Sequence: Synthetic polypeptide
QVTLKESGPGILKPSQTLSLTCSLSGFSLSTSGMGVSWIRQPSGKGLEWLAHIWWDGDSYSNPSLRSRLTISRDTSRNQVFLRIATVDTADTATYYCARRTRVNYAMDYWGQGTSVTVSS

SEQ ID NO: 6664 - protein, 118 aa, Artificial Sequence
  Description of Artificial Sequence: Synthetic polypeptide
EVQLQQSGAEFVRSGASVKLSCTASGLNIKDYYIHWVKQRPEQVLDWIGWIDPENGYSEYAPRFQDKATMTADTSSNTAYLHLSSLTSEDTAVYYCNPGELARYFDYWGQGTTLTVSS

SEQ ID NO: 6665 - protein, 117 aa, Artificial Sequence
  Description of Artificial Sequence: Synthetic polypeptide
VTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSS

SEQ ID NO: 6666 - protein, 118 aa, Artificial Sequence [sequence omitted]

SEQ ID NO: 6667 - protein, 127 aa, Artificial Sequence [sequence omitted]

SEQ ID NO: 6668 - protein, 120 aa, Artificial Sequence
  Description of Artificial Sequence: Synthetic polypeptide
QIQLVQSGPDSKKPGETVKLSCRASGYTFTNYGMNWVKQAPGKGLKWMGWINTYSGVPTYADDFKGQFAFSLETSAATAFLQINNLKDEDTATYFCAREGYSTTRSMDYWGQGTSVTVSS

SEQ ID NO: 6669 - protein, 115 aa, Artificial Sequence
  Description of Artificial Sequence: Synthetic polypeptide
EVQLQQSGAELVKPGASVKLSCTASGFKIKDTYIHWVIQRPAQGLEWIGRIDPANGNTIYGSKFQGKATLTADTSSNTAYIHLSSLTSGDSAVYYCAGYVWFAYWGQGTLVTVSA

SEQ ID NO: 6670 - protein, 115 aa, Artificial Sequence; identical to SEQ ID NO: 6669
  Description of Artificial Sequence: Synthetic polypeptide

SEQ ID NO: 6671 - protein, 115 aa, Artificial Sequence
  Description of Artificial Sequence: Synthetic polypeptide
EVQVQQSGAELVKPGASVKLSCTASGFKIKDTYIHWLKQRPEQGLEWIGRIDPANGNTIYGSKFQGKATITADTSSNTAYIQLSSLTSGDTAVYFCAGYVWFAYWGQGTLVTVSA

SEQ ID NO: 6672 - protein, 120 aa, Artificial Sequence
  Description of Artificial Sequence: Synthetic polypeptide
EVKLVESGGGLVKPGGSLKLSCAASGFTFSNYAMSWVRQNPAKRLEWVATISSGGANIYYPDSVKGRFIISRDNARNTLYLQMSSLRSEDTAMYYCARGDYFNHFWFAYWGQGTLVTVSA

SEQ ID NO: 6673 - protein, 120 aa, Artificial Sequence
  Description of Artificial Sequence: Synthetic polypeptide
EVKLVESGGGLVKPGGSLKLSCAASGFTFSNYAMSWVRQTPAKRLEWVTTISSGGGNIYYTDSVKGRFTVSRDNARNTLYLQMSSLRSEDTAMYYCARGDYSNYFWFAYWGQGTLVSVSE

SEQ ID NO: 6674 - protein, 120 aa, Artificial Sequence
  Description of Artificial Sequence: Synthetic polypeptide
QIQLVQSGPELKKPGETVKLSCRASGYTFTNYGMNWVKQAPGKGLKWMGWINTYSGVPTYADDFKGQFAFSLETSAATAFLQINNLKDEDTATYFCAREGYSTTRSMDYWGQGTSVTVSS

SEQ ID NO: 6675 - protein, 122 aa, Artificial Sequence
  Description of Artificial Sequence: Synthetic polypeptide
EVQLVQSGSELKKPGASVKVSCKASGYTFTNYGMNWVRQAPGQGLEWMGWINTYTGESTYADDFKGRFVFSLDTSVSTAYLQISSLKAEDTAVYYCARGIYYYGSSYAMDYWGQGTTVTVSS

SEQ ID NO: 6676 - protein, 123 aa, Artificial Sequence
  Description of Artificial Sequence: Synthetic polypeptide
AEIQLVQSGSELKKPGASVKVSCKASGYTFTNYGMNWVRQAPGQDLERMAWINTYTGESTYADDFKGRFVFSLDTSVSTAYLQISSLKAEDTAVYFCARGIYYYGSSYAMDYWGQGTTVTVSS

SEQ ID NO: 6677 - protein, 122 aa, Artificial Sequence
  Description of Artificial Sequence: Synthetic polypeptide
EVQLVQSGAEVKKPGASVKVSCKASGYTFTNYGMNWVRQAPGQGLEWMGWINTYTGESTYADDFKGRVTMTTDTSTSTAYMELSSLRSEDTAVYYCARGIYYYGSSYAMDYWGQGTTVTVSS

SEQ ID NO: 6678 - protein, 122 aa, Artificial Sequence
  Description of Artificial Sequence: Synthetic polypeptide
EIQLVQSGAEVKKPGASVKVSCKASGYTFTNYGMNWVRQAPGQDLERMAWINTYTGESTYADDFKGRFTFTLDTSTSTAYMELSSLRSEDTAVYFCARGIYYYGSSYAMDYWGQGTTVTVSS

SEQ ID NO: 6679 - protein, 122 aa, Artificial Sequence
  Description of Artificial Sequence: Synthetic polypeptide
EVQLVQSGAEVKKPGVSVKVSCKASGYTFTTYGMHWVRQAPGQGLEWMGWINTYTGESTYADDFQGRVTFTLDTSTSTAYMELSSLRSEDTAVYFCARGIYYYGSSYAMNYWGQGTTVTVSS

SEQ ID NO: 6680 - protein, 122 aa, Artificial Sequence
  Description of Artificial Sequence: Synthetic polypeptide
EIQLVQSGAEVKKPGASVKVSCKASGYTFKYYGMNWVRQAPGQGLERMGWINTYTGESRYADDFKGRVTFTLDTSTSTAYMELSSLRSEDTAVYYCARDIYYFGSDYAMDYWGQGTTVTVSS

SEQ ID NO: 6681 - protein, 122 aa, Artificial Sequence
  Description of Artificial Sequence: Synthetic polypeptide
EVQLVQSGAEVKKPGASVKVSCKASGYTFKYYGMNWVRQAPGQGLERMGWINTYTGQSTYADDFKGRVTFTLDTSTSTAYMELSSLRSEDTAVYYCARDIYYYGSDFAMDYWGQGTTVTVSS

SEQ ID NO: 6682 - protein, 122 aa, Artificial Sequence
  Description of Artificial Sequence: Synthetic polypeptide
EIQLVQSGAEVKKPGASVKVSCKASGYTFAHYGMNWVRQAPGQGLEWMGWINTYTGQSTYADDFKGRFTFTLDTSTSTAYMELSSLRSEDTAVYYCARGIYYFGSNYAMDYWGQGTTVTVSS

SEQ ID NO: 6683 - protein, 122 aa, Artificial Sequence
  Description of Artificial Sequence: Synthetic polypeptide
EVQLQESGPGLVKPSETLSLTCTVSGFSLSDYGVSWIRQPPGKGLEWLGLIWGGGDTYYNSPLKSRLTISKDNSKSQVSLKLSSVTAADTAVYYCAKQRTLWGYDLYGMDYWGQGTLVTVSS

SEQ ID NO: 6684 - protein, 122 aa, Artificial Sequence
  Description of Artificial Sequence: Synthetic polypeptide
EVQLVESGGGLVQPGGSLRLSCAVSGFTLSDYGVSWIRQAPGKGLEWLGLIWGGGDTYYNSPLKSRLTISKDNSKSTVYLQMNSLRAEDTAVYYCAKQRTLWGYDLYGMDYWGQGTLVTVSS

SEQ ID NO: 6685 - protein, 124 aa, Artificial Sequence
  Description of Artificial Sequence: Synthetic polypeptide
EVQLVESGGGLEQPGGSLRLSCAGSGFTFRDYAMTWVRQAPGKGLEWVSSISGSGGNTYYADSVKGRFTISRDNSKNTLYLQMNSLRAEDTAVYYCAKDRLSITIRPRYYGLDVWGQGTTVTVS

SEQ ID NO: 6686 - protein, 119 aa, Artificial Sequence [sequence omitted]

SEQ ID NO: 6687 - protein, 119 aa, Artificial Sequence [sequence omitted]

SEQ ID NO: 6688 - protein, 116 aa, Artificial Sequence
  Description of Artificial Sequence: Synthetic polypeptide
EVQLVESGGGLVQPGRSLRLSCAASRFTFDDYAMHWVRQAPGKGLEWVSGISWNSGRIGYADSVKGRFTISRDNAENSLFLQMNGLRAEDTALYYCAKGRDSFDIWGQGTMVTVSS

SEQ ID NO: 6689 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAGDTAVYYCARDLIWGVAGSWGQGTMVTVSS

SEQ ID NO: 6690 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDLIFGVGGGWGQGTMVTVSS

SEQ ID NO: 6691 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDLIWGVAGSWGQGTLVTVSS

SEQ ID NO: 6692 - protein, 118 aa, Artificial Sequence; identical to SEQ ID NO: 6691
  Description of Artificial Sequence: Synthetic polypeptide

SEQ ID NO: 6693 - protein, 118 aa, Artificial Sequence; identical to SEQ ID NO: 6691
  Description of Artificial Sequence: Synthetic polypeptide

SEQ ID NO: 6694 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYSPTSVVFGGGTKLTVLGE

SEQ ID NO: 6695 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQTYDPYSVVFGGGTKLTVLGE

SEQ ID NO: 6696 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDLIWGVAGSWGQGTMVTVSS

SEQ ID NO: 6697 - protein, 118 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDLIHGVTRNWGQGTLVTVSS

SEQ ID NO: 6698 - protein, 118 aa, Artificial Sequence; identical to SEQ ID NO: 6697
  Description of Artificial Sequence: Synthetic polypeptide

SEQ ID NO: 6699 - protein, 118 aa, Artificial Sequence; identical to SEQ ID NO: 6697
  Description of Artificial Sequence: Synthetic polypeptide

SEQ ID NO: 6700 - protein, 118 aa, Artificial Sequence; identical to SEQ ID NO: 6691
  Description of Artificial Sequence: Synthetic polypeptide

SEQ ID NO: 6701 - protein, 118 aa, Artificial Sequence; identical to SEQ ID NO: 6697
  Description of Artificial Sequence: Synthetic polypeptide

SEQ ID NO: 6702 - protein, 100 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNLQMNSLRAEDARDLIWGVAGMVTVSS

SEQ ID NO: 6703 - protein, 118 aa, Artificial Sequence; identical to SEQ ID NO: 6690
  Description of Artificial Sequence: Synthetic polypeptide

SEQ ID NO: 6704 - protein, 100 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNLQMNSLRAEDARDLIFGVGGMVTVSS

SEQ ID NO: 6705 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWFEGSIKYYADSVKGISRDNSKNTLYLQMNSLRAEDTAVYYCAREGAGSSLYYYYGMDVWGQGTTVTVSS

SEQ ID NO: 6706 - protein, 120 aa, Artificial Sequence
  Description of Artificial Sequence: Synthetic polypeptide
QEQLVESGGNVVQPGRSLRLSCAASGFTFSTYGMHWVRQAPGKGLEWVAVIWYDGSDKYYADSVKDRFTVSKDNSKNTLYLQMNSLRAEDTAVYYCARNIAVADVAFDLWGQGTMVTVSS

SEQ ID NO: 6707 - protein, 121 aa, Artificial Sequence
  Description of Artificial Sequence: Synthetic polypeptide
QVQLVESGGGVVQPGRSLRLSCAASGFTFSNCGMHWVRQAPGKGLEWVALIGYDGINEYYADSVKGRFTISRDNSKNTLYLQMNSLRAEDTAVFYCARDWPEGYYNGMDVWGQGTTVTVSS

SEQ ID NO: 6708 - protein, 123 aa, Artificial Sequence
  Description of Artificial Sequence: Synthetic polypeptide
EVQLVQSGAEVKKPGESLKISCKGSGYNFPSYWIGWVRQMPGKGLEWMGVISPGDSDTRYSPSFQGQVTISADKSISTAYLQWSSLKASDTAMYYCARGYCSGGSCYPFFQYWGQGTLVTVSS

SEQ ID NO: 6709 - protein, 124 aa, Artificial Sequence
  Description of Artificial Sequence: Synthetic polypeptide
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSS

SEQ ID NO: 6710 - protein, 124 aa, Artificial Sequence
  Description of Artificial Sequence: Synthetic polypeptide
QVQLVESGGGVVQPGRSLRLSCTASGFTFSTYGMHWVRQAPGKGLEWVAIIWFDGSNEDYAASVKGRFTISRDNSKNTLYLQMNSLRAEDTAVYYCAREGDGSSLYYYYGMDVWGQGTTVTVSS

SEQ ID NO: 6711 - protein, 246 aa, Artificial Sequence
  Description of Artificial Sequence: Synthetic polypeptide
QVQLVESGGGVVQPGRSLRLSCTASGFTFSTYGMHWVRQAPGKGLEWVAIIWFDGSNEDYAASVKGRFTISRDNSKNTLYLQMNSLRAEDTAVYYCAREGDGSSLYYYYGMDVWGQGTTVTVSSQVQLVESGGGVVQPGRSLRLSCAASGFTFSNSAMHWVRQAPGKGLEWVALIPFDGYNKYYADSVKGRFTISRDNSKNTLYLQMNSLRAEDTAVYYCAREGGYTGYDGGFDYWGQGILVTVSS

SEQ ID NO: 6712 - protein, 123 aa, Artificial Sequence
  Description of Artificial Sequence: Synthetic polypeptide
QVQLVESGGGVVQPGRSLRLSCAASGFTFSNSGMHWVRQAPGKGLEWVAVIDYDGIIQYYADSVKGRFTISRDNSKNTLYLQINSLRAEDTAVYYCATERGTHYYGSGSFDYWGQGTLVTVSS

SEQ ID NO: 6713 - protein, 120 aa, Artificial Sequence
  Description of Artificial Sequence: Synthetic polypeptide
QVQLVDSGGGVVQPGRSLRLSCAASGFTFNTYGMHWVRQAPGKGLEWVAVISYDGIIKHYADSVKGRFTITRDNSKNMVHLQMNSLRAEDTAVYYCARDSSSWYVYFDYWGQGTLVTVSS

SEQ ID NO: 6714 - protein, 121 aa, Artificial Sequence
  Description of Artificial Sequence: Synthetic polypeptide
QVQLVESGGGVVQPGRSLRLSCAASGFTFSNCGMHWVRQAPGKGLEWVALIGFDGINEYYADSVKGRFTISRDNSKNTLYLQMNSLRAEDTAVYYCARDWPEGYYNGMDVWGQGTTVTVSS

SEQ ID NO: 6715 - protein, 130 aa, Artificial Sequence
  Description of Artificial Sequence: Synthetic polypeptide
QVQLQESGPGLVKPSETLSLTCTISGGSVSSGDYYWSWIRQPPGKGLEWIGNIYYSGSTNYNPSLKSRVTISVDTSKNQFSLKLSSVTAADTAVYYCARGGGTVVRGIIHYYYYYGMDVWGQGTTVTVSS

SEQ ID NO: 6716 - protein, 119 aa, Artificial Sequence
  Description of Artificial Sequence: Synthetic polypeptide
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSS

SEQ ID NO: 6717 - protein, 117 aa, Artificial Sequence
  Description of Artificial Sequence: Synthetic polypeptide
QVQLVESGGGVVQPGRSLRLSCAASGFTFSSYDMSWVRQAPGKGLEWVAKVSSGGGSTYYLDTVQGRFTISRDNSKNTLYLQMNSLRAEDTAVYYCARHLHGSFASWGQGTTVTVSS

SEQ ID NO: 6718 - protein, 123 aa, Artificial Sequence
  Description of Artificial Sequence: Synthetic polypeptide
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSS

SEQ ID NO: 6719 - protein, 124 aa, Artificial Sequence
  Description of Artificial Sequence: Synthetic polypeptide
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVS

SEQ ID NO: 6720 - protein, 125 aa, Artificial Sequence
  Description of Artificial Sequence: Synthetic polypeptide
QIQLVQSGPELKKPGETVKISCKASGFTLTNYGMNWVRQTPGKGLKWMGWINTDTGEPTYADDFKGRFAFSLETSASTASLQINNLKNADTATYFCARNPPYYYGTNNAEAMDYWGQGTAVTVSS

SEQ ID NO: 6721 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDWYFDLWGRGTLVTVSS

SEQ ID NO: 6722 - protein, 118 aa, Artificial Sequence [sequence omitted]

SEQ ID NO: 6723 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGYYDWYFDQWGRGTLVTVSS

SEQ ID NO: 6724 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGQYDWYFDVWGRGTLVTVSS

SEQ ID NO: 6725 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGDYDWYFDLWGRGTLVTVSS

SEQ ID NO: 6726 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGQYDWYFELWGRGTLVTVSS

SEQ ID NO: 6727 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREADIDWFFDLWGRGTLVTVSS

SEQ ID NO: 6728 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHYDWYFDLWGRGTLVTVSS

SEQ ID NO: 6729 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGRYDWYFDPWGRGTLVTVSS

SEQ ID NO: 6730 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGDYDWYFGLWGRGTLVTVSS

SEQ ID NO: 6731 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGRYDWYFDLWGRGTLVTVSS

SEQ ID NO: 6732 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCARESHIDRYFDLWGRGTLVTVSS

SEQ ID NO: 6733 - protein, 119 aa, Artificial Sequence; identical to SEQ ID NO: 6724
  Description of Artificial Sequence: Synthetic polypeptide

SEQ ID NO: 6734 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHYNGYFDLWGRGTLVTVSS

SEQ ID NO: 6735 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGYYDWYFDLWGRGTLVTVSS

SEQ ID NO: 6736 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDWYLDLWGRGTLVTVSS

SEQ ID NO: 6737 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGYYDWYFELWGRGTLVTVSS

SEQ ID NO: 6738 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGLIDWFFDQWGRGTLVTVSS

SEQ ID NO: 6739 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGQFDWYFDLWGRGTLVTVSS

SEQ ID NO: 6740 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDWYFDLWGRGTLVTVSS

SEQ ID NO: 6741 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGENDAFDVWGQGTTVTVSS

SEQ ID NO: 6742 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAYDTWGQGTTVTVSS

SEQ ID NO: 6743 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGTNDAFDIWGQGTTVTVSS

SEQ ID NO: 6744 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAFDSWGQGTTVTVSS

SEQ ID NO: 6745 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAFDTWGQGTTVTVSS

SEQ ID NO: 6746 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAYDRWGQGTTVTVSS

SEQ ID NO: 6747 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDVFDSWGQGTTVTVSS

SEQ ID NO: 6748 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDDDVFDMWGQGTTVTVSS

SEQ ID NO: 6749 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGYNDAFDFWGQGTTVTVSS

SEQ ID NO: 6750 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDDDAYDMWGQGTTVTVSS

SEQ ID NO: 6751 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEQDYDTYDLWGQGTTVTVSS

SEQ ID NO: 6752 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDDDAFDTWGQGTTVTVSS

SEQ ID NO: 6753 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEADDDAFDIWGQGTTVTVSS

SEQ ID NO: 6754 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGENDAFDMWGQGTTVTVSS

SEQ ID NO: 6755 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGEYDTYDIWGQGTTVTVSS

SEQ ID NO: 6756 - protein, 120 aa, Artificial Sequence
  Description of Artificial Sequence: Synthetic polypeptide
QVQLQQSGPELVKPGASVKMSCKASGYTFTSYYIYWVKQRPGQGLEWLGWIWPGDGSTKYNEKFKDKTTLTADKSSNTAYMFLSSLTSEDSAVYFCASPMITPNYAMDYWGQGASVTVSS

SEQ ID NO: 6757 - protein, 120 aa, Artificial Sequence
  Description of Artificial Sequence: Synthetic polypeptide
QVQLQQSGPELVKPGASVKMSCKASGYTFTSYYIHWVKQRPGQGLEWIGWIWPGDGSTKYNEKFKGKTTLTADKSSSTAYMFLSSLTSEDSAVYFCASPMITPNYAMDYWGQGASVTVSS

SEQ ID NO: 6758 - protein, 120 aa, Artificial Sequence
  Description of Artificial Sequence: Synthetic polypeptide
QVQLQQSGSELVKPGASVKLSCKASGYTFTSYYIHWVKQRPGQGLEWIGWIWPGDGSTKYNERFKGKTTLTADKSSSTAYMFLSSLTSEDSAVYFCASPMITPNYAMDYWGQGASVTVSS

SEQ ID NO: 6759 - protein, 120 aa, Artificial Sequence
  Description of Artificial Sequence: Synthetic polypeptide
QVQLQQSGPELVKPGDSVKMSCKASGYSFTSYFIHWVKQRPGQGLEWIGWIWPGDGSTKYNEKFKGKTTLTTDKSSSTAYMFLNSLTSEDSAVYFCASPMITPNYAMDYWGQGASVTVSS

SEQ ID NO: 6760 - protein, 120 aa, Artificial Sequence
  Description of Artificial Sequence: Synthetic polypeptide
QVQLQQSGSELVKPGASVKMSCKASGYTFTSYYIHWVKQRPGQGLEWIGWIWPGDGSTKYNERFKGKTTLTADKSSSTAYMFLSSLTSEDSAVYFCASPMITPNYAMDYWGQGASVTVSS

SEQ ID NO: 6761 - protein, 120 aa, Artificial Sequence
  Description of Artificial Sequence: Synthetic polypeptide
QVQLVQSGAEVKKPGASVKVSCKASGYTFTSYYMHWVRQAPGQGLEWMGIIWPGDGSTSYAQKFQGRVTMTRDTSTSTVYMELSSLRSEDTAVYYCASPMITPNYAMDYWGQGTLVTVSS

SEQ ID NO: 6762 - protein, 120 aa, Artificial Sequence
  Description of Artificial Sequence: Synthetic polypeptide
QVQLVQSGAEVKKPGASVKMSCKASGYTFTSYYIYWVKQAPGQGLEWLGWIWPGDGSTKYNEKFQGRVTLTADKSSNTAYMFLSSLRSEDTAVYFCASPMITPNYAMDYWGQGTLVTVSS

SEQ ID NO: 6763 - protein, 449 aa, Artificial Sequence
  Description of Artificial Sequence: Synthetic polypeptide
QVQLVQSGAEVKKPGASVKVSCKASGYTFTSYYMHWVRQAPGQGLEWMGIIWPGDGSTSYAQKFQGRVTMTRDTSTSTVYMELSSLRSEDTAVYYCASPMITPNYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 6764 - protein, 449 aa, Artificial Sequence
  Description of Artificial Sequence: Synthetic polypeptide
QVQLVQSGAEVKKPGASVKMSCKASGYTFTSYYIYWVKQAPGQGLEWLGWIWPGDGSTKYNEKFQGRVTLTADKSSNTAYMFLSSLRSEDTAVYFCASPMITPNYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 6765 - protein, 142 aa, Artificial Sequence
  Description of Artificial Sequence: Synthetic polypeptide
MEWSGVFLFLLSGTAGVHSEVQLQQSGPELVKPGASVKMSCKASGYTFTDYYMDWVKQSHGESFECIGRVNPYNGGTSYNQKFKGKATLTVDKSSSTAYMELNSLTSEDSAVYYCARLGSSYRWGQGTTLTVSSAKTTPPSV

SEQ ID NO: 6766 - protein, 145 aa, Artificial Sequence
  Description of Artificial Sequence: Synthetic polypeptide
MEWSGIFIFLLSGTAGVHSEVQLQQSGPELVKPGASVKMSCKASGYTFTDYYMDWVKQSHGESFECIGRVNPYNGGTSYNQKFKGKATLTVDKSSSTAYMELNSLTSEDSAVYYCARLGSSYRWGQGTTLTVSSAKTTPPSVYPL

SEQ ID NO: 6767 - protein, 150 aa, Artificial Sequence
  Description of Artificial Sequence: Synthetic polypeptide
MGWSGVFILILSVTTGVHSEVQLQQSGPELEKPGASVKISCKASGYSFTGYNMNWVKQNNGKSLEWIGNITPYYGSTSYNQKFKGRVTLTVDKSSSTAYMQLKSLTSEDSAVYFCLLWLRRGDYAMDYWGQGTSVTVSSAKTTPPSVYPL

SEQ ID NO: 6768 - protein, 441 aa, Artificial Sequence
  Description of Artificial Sequence: Synthetic polypeptide
QVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 6769 - protein, 118 aa, Artificial Sequence
  Description of Artificial Sequence: Synthetic polypeptide
EVQLLESGGGLVQPGGSLRLSCAASGFTFSIYSMNWVRQAPGKGLEWVSSIGSSGGTTYYADSVKGRFTISRDNSKNTLYLQMNSLRAEDTAVYYCAGSQWLYGMDVWGQGTTVTVSS

SEQ ID NO: 6770 - protein, 119 aa, Artificial Sequence; identical to SEQ ID NO: 5166
  Description of Artificial Sequence: Synthetic polypeptide

SEQ ID NO: 6771 - protein, 119 aa, Artificial Sequence
  Description of Artificial Sequence: Synthetic polypeptide
QVQLQQSGAELMKPGASVKISCKASGYTFTSYWIEWIKQRPGHGLEWIGEILPGTGSLNNNEKFRDKATFTADTSSNTAYMQLSSLTSEDSAVYYCARGYRYDGWFAYWGQGTLVTVSA

SEQ ID NO: 6772 - protein, 119 aa, Artificial Sequence
  Description of Artificial Sequence: Synthetic polypeptide
EVQLVESGGGLVQPGGSLKLSCAASGFTFNNYYMSWVRQTPERRLEWVAYISSSGGSTYYSDSVRGRFTISRDTARNTLYLQMTSLKSEDTAMYYCARHFGDYSYFDYWGQGTTLTVSS

SEQ ID NO: 6773 - protein, 118 aa, Artificial Sequence
  Description of Artificial Sequence: Synthetic polypeptide
KIQLVQSGPELKKPGETVKISCKASGYTFTNYGMNWVKQAPGKGLKWMGWININTGEPTYAEEFKGRFAFSLETSATTAFLQINNLKNEDTATYLCARDSYSGGFDYWGQGTIVTVSS

SEQ ID NO: 6774 - protein, 122 aa, Artificial Sequence
  Description of Artificial Sequence: Synthetic polypeptide
QIQLVQSGPELKKPGETVKISCKASGYTFTDYSMHWVKQAPGKGLKWMGWIHTETGEPRYVDDFKGRFAFSLETSASTAYLQINNLKNEDTATYFCARDSYYFGSSYYFDYWGQGTTLTVSS

SEQ ID NO: 6775 - protein, 123 aa, Artificial Sequence
  Description of Artificial Sequence: Synthetic polypeptide
EVQLQQSGPELVKPGASMKISCKASDYSFTAYTIHWMKQSHGKNLEWIGLINPYNGGTSYNQKFQGRATLTVDKSSSIAYMELLSLTSEDSAVYYCARRGYDREGHYYAMDYWGQGTSVTVSS

SEQ ID NO: 6776 - protein, 122 aa, Artificial Sequence
  Description of Artificial Sequence: Synthetic polypeptide
EVQLQQSGPELVQPGASMKISCKASGYSFTDYTMNWVKQSHGKNLEWIGLINPYNGGSRYNQKFMAKATLTVDKSSNTAYMELLSVTSEDSAVYYCARDAGYFGSGFYFDYWGQGTTLTVSS

SEQ ID NO: 6777 - protein, 118 aa, Artificial Sequence
  Description of Artificial Sequence: Synthetic polypeptide
QVQLQQPGSELVRPGASVKLSCKASGYTFTSYWMHWVKQRPGQGLEWIGNIYPGTVNTNYDEKFKNKATLTVDTSSSTAYMLLSSLTSEDSAVYYCTRDYYGGGLNYWGQGTTLTVSS

SEQ ID NO: 6778 - protein, 117 aa, Artificial Sequence
  Description of Artificial Sequence: Synthetic polypeptide
QIQLVQSGPELRKPGETVKISCKGSGYTFTHYGINWVKQTPRKDLKWMGWINTHTGEAYYADDFKGRFAFSLETSANTAYLQINNLNNGDMGTYFCTRSHRFGLDYWGQGTSVTVSS

SEQ ID NO: 6779 - protein, 112 aa, Artificial Sequence
  Description of Artificial Sequence: Synthetic polypeptide
QVQLQQPGAELVRPGASVKLSCKASGYTFTSYWMNWVKQRPEQGLEWIGRIDPYDSETHYNQKFKDKAILTVDKSSSTAFVQLTSLTSEDSAVYYCVSDGYWGAGTTVTVSS

SEQ ID NO: 6780 - protein, 112 aa, Artificial Sequence; identical to SEQ ID NO: 6779
  Description of Artificial Sequence: Synthetic polypeptide

SEQ ID NO: 6781 - protein, 119 aa, Artificial Sequence
  Description of Artificial Sequence: Synthetic polypeptide
EVQLQQSGPDLVKPGASVRISCKASGYTFTDYNLHWVKQSHGKSLEWIGYIYPYNGITGYNQKFKSKATLTVDSSSNTAYMDLRSLTSEDSAVYFCARDAYDYDYLTDWGQGTLVTVSA

SEQ ID NO: 6782 - protein, 151 aa, Artificial Sequence
  Description of Artificial Sequence: Synthetic polypeptide
LNMERHWIFLFLLSVTAGVHSQVLLQQSAPELARPGASVKMSCTASGYIFTNYPIHWVKQRPGQGLEWIGFIDPGGGYDEPDERFRDRATLTADKSSSTAYMQLSSLTSEDSAIYYCARRGGGYYLDYWGQDTTLTVSAASTTPPSVKGEF

SEQ ID NO: 6783 - protein, 117 aa, Artificial Sequence
  Description of Artificial Sequence: Synthetic polypeptide
QVQLVQSGSELKKPGASVKISCKASGYSFSNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 6784 - protein, 117 aa, Artificial Sequence
  Description of Artificial Sequence: Synthetic polypeptide
QVQLVQSGSELKKPGASVKISCKASGYTFTNYGMNWVRQAPGQGLQWMGWINTDSGESTYAEEFKGRFVFSLDTSVSTAYLQITSLTAEDTGMYFCAKVGYDALDYWGQGTLVTVSS

SEQ ID NO: 6785 - protein, 117 aa, Artificial Sequence
  Description of Artificial Sequence: Synthetic polypeptide
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 6786 - protein, 117 aa, Artificial Sequence
  Description of Artificial Sequence: Synthetic polypeptide
QIQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 6787 - protein, 117 aa, Artificial Sequence
  Description of Artificial Sequence: Synthetic polypeptide
QIQLVQSGSELKKPGASVKISCKASGYTFTNYGMNWVKQAPGQGLKWMGWINTDSGESTYAEEFKGRFAFSLDTSVNTAYLQITSLNAEDTGMYFCVRVGYDALDYWGQGTLVTVSS

SEQ ID NO: 6788 - protein, 117 aa, Artificial Sequence
  Description of Artificial Sequence: Synthetic polypeptide
QVQLQQPGSELVRPGASVKLSCKASGYTFTTYWMHWVRQRPGQGLEWIGNIYPGTGGSNFDEKFKNRTSLTVDTSSTTAYMHLASLTSEDSAVYYCTRWTTGTGAYWGQGTLVTVSA

SEQ ID NO: 6789 - protein, 117 aa, Artificial Sequence
  Description of Artificial Sequence: Synthetic polypeptide
QVQLQQSGSELVRPGASVKLSCKASGYTFTTYWMHWVRQRPGQGLEWIGNIYPGTGGSNFDEKFKNRTSLTVDTSSTTAYMHLASLTSEDSAVYYCTRWTTGTGAYWGQGTLVTVSA

SEQ ID NO: 6790 - protein, 113 aa, Artificial Sequence [sequence omitted]

SEQ ID NO: 6791 - protein, 120 aa, Artificial Sequence
  Description of Artificial Sequence: Synthetic polypeptide
QVQLVESGGGLVKPGGSLRLSCAASGFTFSDYYMNWIRQAPGKGLEWVSYISSSGSIIYYADSVKGRFTISRDNAKNSLYLQMNSLRAEDTAVYYCARDGRIVARGMDVWGQGTTVTVSS

SEQ ID NO: 6792 - protein, 120 aa, Artificial Sequence
  Description of Artificial Sequence: Synthetic polypeptide
EVQLRDSGGGLVQPGGSLRLSCVASGFTFSSYWMSWVRQAPGKGLEWVVNINRDGSEKYYVDSVKGRFIISRDNTKNSLYLQMESLRAEDTAVYYCARDPPYHLYGMDVWGQGTTVTVSS

SEQ ID NO: 6793 - protein, 122 aa, Artificial Sequence
  Description of Artificial Sequence: Synthetic polypeptide
QLQLQESGPGLVKPSETLSLTCTVSGGSITSSSYYWGWIRQPPGKGLEWIGSIYYRGSTNYNPSLKSRVTISVDSSKNQFYLKVSSVTAVDTAVYYCARQNGAARPSWFDPWGQGTLVTVSS

SEQ ID NO: 6794 - protein, 127 aa, Artificial Sequence
  Description of Artificial Sequence: Synthetic polypeptide
EVQLVESGGGLVQPGGSLRLSCAASGFTFSSYWMSWVRQAPGKGLEWVANMNQDGSETHYVDSVKGRLSISRDNAKKSLFLHMNSLRAEDTAVYFCARDLVPPRQDDYYYYFGMDVWGHGTTVTVSS

SEQ ID NO: 6795 - protein, 127 aa, Artificial Sequence
  Description of Artificial Sequence: Synthetic polypeptide
EVQLVESGGGLVQPGGSLRLSCGASGFTFSSYWMTWVRQAPGKGLEWVGNINQDGSEKYSVDSVKGRFTISRDNAKNSLYLQMNRVRAEDTAVYYCSRDLVPPRQGDNYYYFGMDVWGLGTTVTVSS

SEQ ID NO: 6796 - protein, 127 aa, Artificial Sequence
  Description of Artificial Sequence: Synthetic polypeptide
EVQLVQSGGSLVQPGGSLRLSCTASGFTFSSYWMSWVRQAPGKGLEWVANIQQDESEKYYVDSVKGRFSISRDNAKKSLYLQMNSLRAEDTAVYFCARDLVPPRQGDYYHYFGMDVWGQGTLVTVSS

SEQ ID NO: 6797 - protein, 121 aa, Artificial Sequence
  Description of Artificial Sequence: Synthetic polypeptide
QLQLQESGPGLVKPSETLSLTCIVSGGSISSSSYYWGWIRQPPGKGLEWIGSLYYSGITFYNPSLKSRVTISVDTSKNQFSLTLTSVTAADTAVFYCARHRVMASSPFDHWGQGTLVTVSS

SEQ ID NO: 6798 - protein, 123 aa, Artificial Sequence
  Description of Artificial Sequence: Synthetic polypeptide
QVQLVESGAEMKKPGASVKVSCKASGYTFTDYGINWVRQAPGQGLEWMGWVSGYNGNTVFAQKIQGRVTMTTDTSTSTAYMELRSLRSDDTAVYFCARISVRGHSYYHGMGVWGQGTTVTVSS

SEQ ID NO: 6799 - protein, 120 aa, Artificial Sequence
  Description of Artificial Sequence: Synthetic polypeptide
QVQLVESGGGVVQPGRSLRLSCAASGFTFSSYGLHWVRQAPGKGLEWVALISNVGSNKYYADSVKGRFTISRDNSKNSLFLQMNSLRAEDTAVYYCAKGADYYYYGMDVWGQGTTVTVSS

SEQ ID NO: 6800 - protein, 118 aa, Artificial Sequence
  Description of Artificial Sequence: Synthetic polypeptide
EVQLVESGGGVVQPGRSLRLSCAASGFTFSNYGMHWVRQAPGKGLEWVTVIWYDGSYKYYADSVKGRFTISRDNSKNRLYLQMNSLRAEDTAVYYCARGELGDAFDIWGQGTMVTVSS

SEQ ID NO: 6801 - protein, 124 aa, Artificial Sequence
  Description of Artificial Sequence: Synthetic polypeptide
QITLKESGPTLVKPTQTLTLTCTFSGFSLTTTGVGVGWIRQPPGKALEWLALIYWNDLKRYSPSLKNRLTITKDTSRHQVVLTMTNMDPMDTATYYCAHRPLYYGSGSGWFDPWGPGTTVTVSS

SEQ ID NO: 6802 - protein, 119 aa, Artificial Sequence
  Description of Artificial Sequence: Synthetic polypeptide
EVQLVESGGDLVHPGRSLRLSCVASGFTFDDYTMHWVRQAPGKGLEWVSAISWNGDNINYAGSVKGRFTISRDNAKNSLYLEMNSLRVEDTAFYYCAKGRGFSFGFNYLGQGTMVTVSS

SEQ ID NO: 6803 - protein, 124 aa, Artificial Sequence
  Description of Artificial Sequence: Synthetic polypeptide
EVQLLQSGGGLVQPGGSLRLSCAASGFTFSHYWMSWVRQGPGKGLEWVATIKKDGSESYYVDSVRGRFTISRDNAKNSLYLQMNSLRTEDTAVYYCARDIVTPNVGYYFGMDVWGQGTTVTVSS

SEQ ID NO: 6804 - protein, 124 aa, Artificial Sequence
  Description of Artificial Sequence: Synthetic polypeptide
QVQLVESGGGLVQPGGSLRLSCAAAGFTFSHYWMSWVRQAPGKGLEWVATIKKDGSERYYVDSVKGRFTISRDNARNSMYLEMNSLRTEDTAIYYCARDIVTPNTDYYFGMDVWGQGTTVTVSS

SEQ ID NO: 6805 - protein, 127 aa, Artificial Sequence
  Description of Artificial Sequence: Synthetic polypeptide
QVQLVESGGSLVQPGGSLRLACTASGFTFSSYWMSWVRQAPGKGLEWVANIQQDENEKYYVDSVKGRFSISRDNAKKSLYLQMNSLRVEDTAVYFCARDLVPPRQGDYYHYFGMDVWGQGTTVTVSS

SEQ ID NO: 6806 - protein, 127 aa, Artificial Sequence
  Description of Artificial Sequence: Synthetic polypeptide
QVQLVESGGGLVQPGGSLRLSCAASGFTFSSYWMSWVRQVPGKGLEWVANMNQDGTEKYYVDSVKGRLTISRENVKNSLYLQMNGLRAEDTAVYYCARDLVPPRQGDYYYYFGMDVWGHGTMVTVSS

SEQ ID NO: 6807 - protein, 118 aa, Artificial Sequence
  Description of Artificial Sequence: Synthetic polypeptide
QVQLVESGGGFVQPGGSLRLSCAASGFTFTNYAMSWVRQAPGKGLEWVSAISGVGGSTYYADSVKGRFTISRDTSKNMLYLQMNSLRAEDTAVYYCAKAPHWGPFGSWGQGTLVTVSS

SEQ ID NO: 6808 - protein, 123 aa, Artificial Sequence
  Description of Artificial Sequence: Synthetic polypeptide
EVQLLESGGDLVQPGGSLRLSCAASGITFSSFAMSWVRQAPGKGLEWVSTVSVSAGITYYADSVKGRFTISRDNSKNTLYLQMNSLRAEDTAIYYCAKSSCTTNSCPAYFDYWGLGTLVTVSS

SEQ ID NO: 6809 - protein, 126 aa, Artificial Sequence
  Description of Artificial Sequence: Synthetic polypeptide
EVQLVESGGGLVQPGGSLRLSCAASGFTFSSYWMTWVRQAPGKGLEWVANIRQDGSDKYYVDSVKGRFTISRDNAKNSLFLQMNSLRAEDTAVYYCARTNGGTYGYNHYYYGMDVWGQGTTVTVSS

SEQ ID NO: 6810 - protein, 123 aa, Artificial Sequence
  Description of Artificial Sequence: Synthetic polypeptide
QVQVQESGPGLVKPSETLSLTCTVSGDSISSSSYYWGWIRQPPGKGLEWIGSIYYNGISSYNPSLKSRVTISVESSKNQFSLRLASVTAADTALYYCARHRAARRFSEAFDIWGQGTMVTVSS

SEQ ID NO: 6811 - protein, 120 aa, Artificial Sequence
  Description of Artificial Sequence: Synthetic polypeptide
EVQLVESGGGLVQPGRSLRLSCAASGFTFDDFAMHWVRQVPGKGLEWVSGISWSSGTIGYVGSVKGRFTISRDNAKNSLYLQMNSLRAEDTAMYFCTKDKAAFHDAFDIWGQGTMVTVSS

SEQ ID NO: 6812 - protein, 123 aa, Artificial Sequence
  Description of Artificial Sequence: Synthetic polypeptide
QVQLQQWGAGLLKPSETLSLTCAVYGGSFSGYYWTWIRQSPGKGLEWMGEISHRGTTNYNPSLKSRLTISLDTSNNHFSLKLSSVTAADTAVYYCAREERLGMGYDYFGLDVWGQGTTVTVSS

SEQ ID NO: 6813 - protein, 121 aa, Artificial Sequence
  Description of Artificial Sequence: Synthetic polypeptide
EVQLLESGGGLVQPGGSLRLSCAASGFTFSKYKMLWVRQAPGKGLEWVSSIYPSGGVTFYADSVKGRFTISRDNSKNTLYLQMNSLRAEDTAVYYCARDGEMISGSFFDSWGQGTLVTVSS

SEQ ID NO: 6814 - protein, 121 aa, Artificial Sequence
  Description of Artificial Sequence: Synthetic polypeptide
EVQLLESGGGLVQPGGSLRLSCAASGFTFSQYMMLWVRQAPGKGLEWVSGISPSGGITTYADSVKGRFTISRDNSKNTLYLQMNSLRAEDTAVYYCARAYSSGWSLPFDYWGQGTLVTVSS

SEQ ID NO: 6815 - protein, 121 aa, Artificial Sequence; identical to SEQ ID NO: 6814
  Description of Artificial Sequence: Synthetic polypeptide

SEQ ID NO: 6816 - protein, 121 aa, Artificial Sequence; identical to SEQ ID NO: 6814
  Description of Artificial Sequence: Synthetic polypeptide

SEQ ID NO: 6817 - protein, 121 aa, Artificial Sequence; identical to SEQ ID NO: 6814
  Description of Artificial Sequence: Synthetic polypeptide

SEQ ID NO: 6818 - protein, 121 aa, Artificial Sequence; identical to SEQ ID NO: 6814
  Description of Artificial Sequence: Synthetic polypeptide

SEQ ID NO: 6819 - protein, 122 aa, Artificial Sequence
  Description of Artificial Sequence: Synthetic polypeptide
EVQLLESGGGLVQPGGSLRLSCAASGFTFSKYKMEWVRQAPGKGLEWVSSISPSGGLTFYADSVKGRFTISRDNSKNTLYLQMNSLRAEDTAVYYCAKARRMRSLWEAFDVWGQGTMVTVSS

SEQ ID NO: 6820 - protein, 122 aa, Artificial Sequence; identical to SEQ ID NO: 6819
  Description of Artificial Sequence: Synthetic polypeptide

SEQ ID NO: 6821 - protein, 122 aa, Artificial Sequence
  Description of Artificial Sequence: Synthetic polypeptide
EVQLLESGGGLVQPGGSLRLSCAASGFTFSKYKMLWVRQAPGKGLEWVSSISPSGGLTFYADSVKGRFTISRDNSKNTLYLQMNSLRAEDTAAYYCAKARRMRSLWEAFDVWGQGTMVTVSS

SEQ ID NO: 6822 - protein, 122 aa, Artificial Sequence; identical to SEQ ID NO: 6819
  Description of Artificial Sequence: Synthetic polypeptide

SEQ ID NO: 6823 - protein, 121 aa, Artificial Sequence; identical to SEQ ID NO: 6814
  Description of Artificial Sequence: Synthetic polypeptide

SEQ ID NO: 6824 - protein, 120 aa, Artificial Sequence
  Description of Artificial Sequence: Synthetic polypeptide
EVQLLESGGGLVQPGGSLRLSCAASGFTFSKYPMVWVRQAPGKGLEWVSSISPSGGLTFYADSVKGRFTISRDNSKNTLYLQMNSLRAEDTAVYYCAKARRMRSLWEAFDVWGQGTTVTV

SEQ ID NO: 6825 - protein, 121 aa, Artificial Sequence
  Description of Artificial Sequence: Synthetic polypeptide
EVQLLESGGGLVQPGGSLRLSCAASGFTFSRYVMTWVRQAPGKGLEWVSSIWPSGGMTVYADSVKGRFTISRDNSKNTLYLQMNSLRAEDTAVYYCARDRPTGKTGYFQHWGQGTLVTVSS

SEQ ID NO: 6826 - protein, 121 aa, Artificial Sequence
  Description of Artificial Sequence: Synthetic polypeptide
EVQLLESGGGLVQPGGSLRLSCAASGFTFSKYMMGWVRQAPGKGLEWVSGISPSGGITTYADSVKGRFTISRDNSKNTLYLQMNSLRAEDTAVYYCARAYSSGWSLPFDYWGQGTLVTVSS

SEQ ID NO: 6827 - protein, 121 aa, Artificial Sequence; identical to SEQ ID NO: 6813
  Description of Artificial Sequence: Synthetic polypeptide

SEQ ID NO: 6828 - protein, 122 aa, Artificial Sequence
  Description of Artificial Sequence: Synthetic polypeptide
EVQLLESGGGLVQPGGSLRLSCAASGFTFSKYPMVWVRQAPGKGLEWVSSISPSGGLTFYADSVKGRFTISRDNSKNTLYLQMNSLRAEDTAVYYCAKARRMRSLWEAFDVWGQGTLVTVSS

SEQ ID NO: 6829 - protein, 121 aa, Artificial Sequence; identical to SEQ ID NO: 6814
  Description of Artificial Sequence: Synthetic polypeptide

SEQ ID NO: 6830 - protein, 122 aa, Artificial Sequence; identical to SEQ ID NO: 6819
  Description of Artificial Sequence: Synthetic polypeptide

SEQ ID NO: 6831 - protein, 122 aa, Artificial Sequence
  Description of Artificial Sequence: Synthetic polypeptide
EVQLLESGGGLVQPGGSLRLSCAASGFTFSKYRMSWVRQAPGKGLEWVSSISPSGGLTFYADSVKGRFTISRDNSKNTLYLQMNSLRAEDTAVYYCAKARRMRSLWEAFDVWGQGTLVTVSS

SEQ ID NO: 6832 - protein, 112 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWG

SEQ ID NO: 6833 - protein, 113 aa, Artificial Sequence
  Description of Artificial Sequence: Synthetic polypeptide
EVQLLESGGGLVQPGGSLRLSCAASGFTFSGYIMWWVRQAPGKGLEWVSVISPSGGDTWYADSVKGRFTISRDNSKNTLYLQMNSLRAEDTAVYYCATAGDYWGQGTLVTVSS

SEQ ID NO: 6834 - protein, 121 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTLVTVSS

SEQ ID NO: 6835 - protein, 121 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTMVTVSS

SEQ ID NO: 6836 - protein, 121 aa, Artificial Sequence; identical to SEQ ID NO: 6835
  Description of Artificial Sequence: Synthetic polypeptide

SEQ ID NO: 6837 - protein, 121 aa, Artificial Sequence; identical to SEQ ID NO: 6834
  Description of Artificial Sequence: Synthetic polypeptide

SEQ ID NO: 6838 - protein, 121 aa, Artificial Sequence; identical to SEQ ID NO: 6834
  Description of Artificial Sequence: Synthetic polypeptide

SEQ ID NO: 6839 - protein, 121 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDDYSKGRDAFDIWGQGTTVTVSS

SEQ ID NO: 6840 - protein, 126 aa, Artificial Sequence
  Description of Artificial Sequence: Synthetic polypeptide
EVQLLESGGGLVQPGGSLRLSCAASGFTFSNYHMFWVRQAPGKGLEWVSVISPSGGSTGYADSVKGRFTISRDNSKNTLYLQMNSLRAEDTAMYYCARFDGDYLWDDYRHDAFDIWGQGTMVTVSS

SEQ ID NO: 6841 - protein, 121 aa, Artificial Sequence; identical to SEQ ID NO: 6839
  Description of Artificial Sequence: Synthetic polypeptide

SEQ ID NO: 6842 - protein, 121 aa, Artificial Sequence; identical to SEQ ID NO: 6839
  Description of Artificial Sequence: Synthetic polypeptide

SEQ ID NO: 6843 - protein, 121 aa, Artificial Sequence; identical to SEQ ID NO: 6835
  Description of Artificial Sequence: Synthetic polypeptide

SEQ ID NO: 6844 - protein, 121 aa, Artificial Sequence
  Description of Artificial Sequence: Synthetic polypeptide
EVQLLESGGGLVQPGGSLRLSCAASGLTFSKYDMHWVRQAPGKGLEWVSVISPSGGWTSYADSVKGRFTISRDNSKNTLYLQMNSLRAEDTAMYYCARDDYSKGRDAFDIWGQGTTVTVSS

SEQ ID NO: 6845 - protein, 121 aa, Artificial Sequence
  Description of Artificial Sequence: Synthetic polypeptide
EVQLLESGGGLVQPGGSLRLSCAASGFTFSDYLMVWVRQAPGKGLEWVSYISPSGGWTAYADSVKGRFTISRDNSKNTLYLQMNSLRAEDTAVYYCARVVELRAGDAFDIWGQGTLVTVSS

SEQ ID NO: 6846 - protein, 121 aa, Artificial Sequence; identical to SEQ ID NO: 6835
  Description of Artificial Sequence: Synthetic polypeptide

SEQ ID NO: 6847 - protein, 121 aa, Artificial Sequence; identical to SEQ ID NO: 6834
  Description of Artificial Sequence: Synthetic polypeptide

SEQ ID NO: 6848 - protein, 121 aa, Artificial Sequence
  Description of Artificial Sequence: Synthetic polypeptide
EVQLLESGGGLVQPGGSLRLSCAASGFTFSRYDMEWVRQAPGKGLEWVSSISPSGGWTSYADSVKGRFTISRDNSKNTLYLQMNSLRAEDTAVYYCARDHSGYDSEYFDYWGQGTLVTVSS

SEQ ID NO: 6849 - protein, 121 aa, Artificial Sequence; identical to SEQ ID NO: 6835
  Description of Artificial Sequence: Synthetic polypeptide

SEQ ID NO: 6850 - protein, 113 aa, Artificial Sequence; identical to SEQ ID NO: 6833
  Description of Artificial Sequence: Synthetic polypeptide

SEQ ID NO: 6851 - protein, 122 aa, Artificial Sequence
  Description of Artificial Sequence: Synthetic polypeptide
EVQLLESGGGLVQPGGSLRLSCAASGFTFSKYKMQWVRQAPGKGLEWVSSISPSGGLTFYADSVKGRFTISRDNSKNTLYLQMNSLRAEDTAVYYCAKARRMRSLWEAFDIWGQGTMVTVSS

SEQ ID NO: 6852 - protein, 121 aa, Artificial Sequence; identical to SEQ ID NO: 6835
  Description of Artificial Sequence: Synthetic polypeptide

SEQ ID NO: 6853 - protein, 118 aa, Artificial Sequence
  Description of Artificial Sequence: Synthetic polypeptide
EVQLLESGGGLVQPGGSLRLSCAASGFTFSHYEMGWVRQAPGKGLEWVSYISSSGGWTAYADSVKGRFTISRDNSKNTLYLQMNSLRAEDTAVYYCARIGYADAFDIWGQGTTVTVSS

SEQ ID NO: 6854 - protein, 113 aa, Artificial Sequence; identical to SEQ ID NO: 6833
  Description of Artificial Sequence: Synthetic polypeptide

SEQ ID NO: 6855 - protein, 121 aa, Artificial Sequence
  Description of Artificial Sequence: Synthetic polypeptide
EVQLLGSGGGLVQPGGSLRLSCAASGFTFSRYDMEWVRQAPGKGLEWVSSISPSGGWTSYADSVKGRFTISRDNSKNTLYLQMNSLRAEDTAVYYCARDHSGYDSEYFDYWGQGTLVTVSS

SEQ ID NO: 6856 - protein, 121 aa, Artificial Sequence; identical to SEQ ID NO: 6834
  Description of Artificial Sequence: Synthetic polypeptide

SEQ ID NO: 6857 - protein, 121 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWTSYADSVKGRFTISRDNSKNTLYLQMNSLRAEDTAMYYCARDGYSKGRDAFDIWGQGTLVTVSS

SEQ ID NO: 6858 - protein, 121 aa, Artificial Sequence; identical to SEQ ID NO: 6834
  Description of Artificial Sequence: Synthetic polypeptide

SEQ ID NO: 6859 - protein, 121 aa, Artificial Sequence; identical to SEQ ID NO: 6834
  Description of Artificial Sequence: Synthetic polypeptide

SEQ ID NO: 6860 - protein, 121 aa, Artificial Sequence; identical to SEQ ID NO: 6835
  Description of Artificial Sequence: Synthetic polypeptide

SEQ ID NO: 6861 - protein, 113 aa, Artificial Sequence; identical to SEQ ID NO: 6833
  Description of Artificial Sequence: Synthetic polypeptide

SEQ ID NO: 6862 - protein, 121 aa, Artificial Sequence; identical to SEQ ID NO: 6813
  Description of Artificial Sequence: Synthetic polypeptide

SEQ ID NO: 6863 - protein, 121 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARDHSGYDSEYFDYWGQGTLVTVSS

SEQ ID NO: 6864 - protein, 118 aa, Artificial Sequence
  Description of Artificial Sequence: Synthetic polypeptide
EVQLLESGGGLVQPGGSLRLSCAASGFTFSHYEMGWVRQAPGKGLEWVSYISPSGGWTAYADSVKGRFTISRDNSKNTLYLQMNSLRAEDTAVYYCARIDYADAFDIWGQGTLVTVSS

SEQ ID NO: 6865 - protein, 113 aa, Artificial Sequence; identical to SEQ ID NO: 6833
  Description of Artificial Sequence: Synthetic polypeptide

SEQ ID NO: 6866 - protein, 121 aa, Artificial Sequence; identical to SEQ ID NO: 6835
  Description of Artificial Sequence: Synthetic polypeptide

SEQ ID NO: 6867 - protein, 121 aa, Artificial Sequence; identical to SEQ ID NO: 6839
  Description of Artificial Sequence: Synthetic polypeptide

SEQ ID NO: 6868 - protein, 121 aa, Artificial Sequence; identical to SEQ ID NO: 6835
  Description of Artificial Sequence: Synthetic polypeptide

SEQ ID NO: 6869 - protein, 113 aa, Artificial Sequence; identical to SEQ ID NO: 6833
  Description of Artificial Sequence: Synthetic polypeptide

SEQ ID NO: 6870 - protein, 121 aa, Artificial Sequence; identical to SEQ ID NO: 6834
  Description of Artificial Sequence: Synthetic polypeptide

SEQ ID NO: 6871 - protein, 113 aa, Artificial Sequence; identical to SEQ ID NO: 6833
  Description of Artificial Sequence: Synthetic polypeptide

SEQ ID NO: 6872 - protein, 121 aa, Artificial Sequence; identical to SEQ ID NO: 6834
  Description of Artificial Sequence: Synthetic polypeptide

SEQ ID NO: 6873 - protein, 121 aa, Artificial Sequence; identical to SEQ ID NO: 6813
  Description of Artificial Sequence: Synthetic polypeptide

SEQ ID NO: 6874 - protein, 113 aa, Artificial Sequence; identical to SEQ ID NO: 6833
  Description of Artificial Sequence: Synthetic polypeptide

SEQ ID NO: 6875 - protein, 122 aa, Artificial Sequence
  Description of Artificial Sequence: Synthetic polypeptide
EVQLLESGGGLVQPGGSLRLSCAASGFTFSWYDMDWVRQAPGKGLEWVSVISPSGGWTAYADSVKGRFTISRDNSKNTLYLQMNSLRAEDTAVYYCARDSSGYYSPDAFDIWGQGTLVTVSS

SEQ ID NO: 6876 - protein, 121 aa, Artificial Sequence; identical to SEQ ID NO: 6834
  Description of Artificial Sequence: Synthetic polypeptide

SEQ ID NO: 6877 - protein, 113 aa, Artificial Sequence; identical to SEQ ID NO: 6833
  Description of Artificial Sequence: Synthetic polypeptide

SEQ ID NO: 6878 - protein, 118 aa, Artificial Sequence
  Description of Artificial Sequence: Synthetic polypeptide
EVQLLESGGGLVQPGGSLRLSCAASGFTFSRYEMGWVRQAPGKGLEWVSYISPSGGWTAYADSVKGRFTISRDNSKNTLYLQMNSLRAEDTAVYYCARIDYADAFDIWGQGTMVTVSS

SEQ ID NO: 6879 - protein, 113 aa, Artificial Sequence; identical to SEQ ID NO: 6833
  Description of Artificial Sequence: Synthetic polypeptide

SEQ ID NO: 6880 - protein, 121 aa, Artificial Sequence; identical to SEQ ID NO: 6834
  Description of Artificial Sequence: Synthetic polypeptide

SEQ ID NO: 6881 - protein, 118 aa, Artificial Sequence
  Description of Artificial Sequence: Synthetic polypeptide
EVQLLESGGGLVQPGGSLRLSCAASGFTFSHYEMAWVRQAPGKGLEWVSYISSSGGWTSYADSVKGRFTISRDNSKNTLYLQMNSLRAEDTAVYYCARIDYADAFDIWGQGTTVTVSS

SEQ ID NO: 6882 - protein, 118 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTTVTVSS

SEQ ID NO: 6883 - protein, 118 aa, Artificial Sequence
  Description of Artificial Sequence: Synthetic polypeptide
EVQLLESGGGLVQPGGSLRLSCAASGFTFSHYEMAWVRQAPGKGLEWVSYISPSGGWTSYADSVKGRFTISRDNSKNTLYLQMNSLRAEDTAVYYCAREGPLDAFDIWGQGTTVTVSS

SEQ ID NO: 6884 - protein, 121 aa, Artificial Sequence; identical to SEQ ID NO: 6825
  Description of Artificial Sequence: Synthetic polypeptide

SEQ ID NO: 6885 - protein, 121 aa, Artificial Sequence; identical to SEQ ID NO: 6839
  Description of Artificial Sequence: Synthetic polypeptide

SEQ ID NO: 6886 - protein, 121 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWASYADSVKGRFTISRDNSKNTLYLQMNSLRAEDTAMYYCARDDYSKGRDAFDIWGQGTTVTVSS

SEQ ID NO: 6887 - protein, 121 aa, Artificial Sequence; identical to SEQ ID NO: 6834
  Description of Artificial Sequence: Synthetic polypeptide

SEQ ID NO: 6888 - protein, 121 aa, Artificial Sequence; identical to SEQ ID NO: 6834
  Description of Artificial Sequence: Synthetic polypeptide

SEQ ID NO: 6889 - protein, 118 aa, Artificial Sequence
  Description of Artificial Sequence: Synthetic polypeptide
EVQLLESGGGLVQPGGSLRLSCAASGFTFSHYEMGWVRQAPGKGLEWVSYISSSGGWTTYADSVKGRFTISRDNSKNTLYLQMNSLRAEDTAVYYCARIDYADAFDIWGQGTLVTVSS

SEQ ID NO: 6890 - protein, 118 aa, Artificial Sequence; identical to SEQ ID NO: 6889
  Description of Artificial Sequence: Synthetic polypeptide

SEQ ID NO: 6891 - protein, 118 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTLVTVSS

SEQ ID NO: 6892 - protein, 118 aa, Artificial Sequence; identical to SEQ ID NO: 6891
  Description of Artificial Sequence: Synthetic polypeptide

SEQ ID NO: 6893 - protein, 118 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTMVTVSS

SEQ ID NO: 6894 - protein, 113 aa, Artificial Sequence; identical to SEQ ID NO: 6833
  Description of Artificial Sequence: Synthetic polypeptide

SEQ ID NO: 6895 - protein, 121 aa, Artificial Sequence; identical to SEQ ID NO: 6813
  Description of Artificial Sequence: Synthetic polypeptide

SEQ ID NO: 6896 - protein, 118 aa, Artificial Sequence; identical to SEQ ID NO: 6893
  Description of Artificial Sequence: Synthetic polypeptide

SEQ ID NO: 6897 - protein, 118 aa, Artificial Sequence
  Description of Artificial Sequence: Synthetic polypeptide
EVQLLESGGGLVQPGGSLRLSCAASGFTFSWYDMGWVRQAPGKGLEWVSVISPSGGWTSYADSVKGRFTISRDNSKNTLYLQMNSLRAEDTAVYYCARASSGDAFDIWGQGTLVTVSS

SEQ ID NO: 6898 - protein, 121 aa, Artificial Sequence
  Description of Artificial Sequence: Synthetic polypeptide
EVQLLESGGGLVQPGGSLRLSCAASGFTFSKYDMHWVRQAPGKGLEWVSVISPSGGWTSYADPVKGRFTISRDNSKNTLYLQMNSLRAEDTAMYYCARDDYSKGRDAFDIWGQGTMVTVSS

SEQ ID NO: 6899 - protein, 116 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSKNTLYLQMNSLRAEDTAVYYCARASSGDAFDIWGQGTTVTV

SEQ ID NO: 6900 - protein, 121 aa, Artificial Sequence; identical to SEQ ID NO: 6848
  Description of Artificial Sequence: Synthetic polypeptide

SEQ ID NO: 6901 - protein, 113 aa, Artificial Sequence
  Description of Artificial Sequence: Synthetic polypeptide
DVQLLESGGGLVQPGGSLRLSCAASGFTSSGYIMWWVRQAPGKGLEWVSVISPSGGDTWYADSVKGRFTISRDNSKNTLYLQMNSLRAEDTAVYYCATAGDYWGQGTLVTVSS

SEQ ID NO: 6902 - protein, 121 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSKNTLYLQMNSLRAEDTAMYYCARDDYSKGRDAFDIWGQGTLVTVSS

SEQ ID NO: 6903 - protein, 118 aa, Artificial Sequence
  Description of Artificial Sequence: Synthetic polypeptide
EVQLLESGGGLVQPGGSLRLSCAASGFTFSWYDMVWVRQAPGKGLEWVSVISPSGGWTSYADSVKGRFTISRDNSRNTLYLQMNSLRAEDTAMYYCARASSGDAFDIWGQGTLVTVSS

SEQ ID NO: 6904 - protein, 113 aa, Artificial Sequence
  Description of Artificial Sequence: Synthetic polypeptide
EVQLLESGGGLVQPGGSLRLSCAASGFTSSGYIMWWVRQAPGKGLEWVSVISPSGGDTWYADSVKGRFTISRDNSKNTLYLQMNSLRAEDTAVYYCATAGDYWGQGTLVTVSS

SEQ ID NO: 6905 - protein, 121 aa, Artificial Sequence; identical to SEQ ID NO: 6814
  Description of Artificial Sequence: Synthetic polypeptide

SEQ ID NO: 6906 - protein, 122 aa, Artificial Sequence
  Description of Artificial Sequence: Synthetic polypeptide
EVQLLESGGGLVQPGGSLRLSCAASGFTFSMYFMSWVRQAPGKGLEWVSGISPSGGMTFYADSVKGRFTISRDNSKNTLYLQMNSLRAEDTAVYYCAKDGIPLSIAAPIDYWGQGTLVTVSS

SEQ ID NO: 6907 - protein, 121 aa, Artificial Sequence
  Description of Artificial Sequence: Synthetic polypeptide
EVQLLESGGGLVQPGGSLRLSCAASGLTFSRYVMTWVRQAPGKGLEWVSSIWPSGGMTVYADSVKGRFTISRDNSKNTLYLQMNSLRAEDTAVYYCARDRPTGKTGYFQHWGQGTLVTVSS

SEQ ID NO: 6908 - protein, 121 aa, Artificial Sequence; identical to SEQ ID NO: 6814
  Description of Artificial Sequence: Synthetic polypeptide

SEQ ID NO: 6909 - protein, 122 aa, Artificial Sequence
  Description of Artificial Sequence: Synthetic polypeptide
EVQLLESGGGLVQPGGSLRLSCAASGFTFSGYIMQWVRQAPGKGLEWVSSISPSGGLTFYADSVKGRFTISRDNSKNTLYLQMNSLRAEDTAVYYCAKARRMRSLWEAFDVWGQGTTVTVSS

SEQ ID NO: 6910 - protein, 122 aa, Artificial Sequence; identical to SEQ ID NO: 6819
  Description of Artificial Sequence: Synthetic polypeptide

SEQ ID NO: 6911 - protein, 122 aa, Artificial Sequence
  Description of Artificial Sequence: Synthetic polypeptide
EVQLLESGGGLVQPGGSLRLSCAASGFTFSNYSMTWVRQAPGKGLEWVSSISPSGGLTFYADSVKGRFTISRDNSKNTLYLQMNSLRAEDTAVYYCAKARRMRSLWEAFDIWGQGTMVTVSS

SEQ ID NO: 6912 - protein, 121 aa, Artificial Sequence
  Description of Artificial Sequence: Synthetic polypeptide
EVQLLESGGGLVQPGGSLRLSCAASGFTFSKYPMTWVRQAPGKGLEWVSSIWPSGGMTVYADSVKGRFTISRDNSKNTLYLQMNSLRAEDTAVYYCARDRPTGKTGYFQHWGQGTLVTVSS

SEQ ID NO: 6913 - protein, 121 aa, Artificial Sequence
  Description of Artificial Sequence: Synthetic polypeptide
EVQLLESGGGLVQPGGSLRLSCAASGFTFSQYMMLWVRQAPGKGLEWVSGISPSGGITTYADSVKGRFTISRDNSKNTLYLRMNSLRAEDTAVYYCARAYSSGWSLPFDYWGQGTLVTVSS

SEQ ID NO: 6914 - protein, 121 aa, Artificial Sequence; identical to SEQ ID NO: 6813
  Description of Artificial Sequence: Synthetic polypeptide

SEQ ID NO: 6915 - protein, 121 aa, Artificial Sequence
  Description of Artificial Sequence: Synthetic polypeptide
EVQLLESGGGLVQPGGSLRLSCAASGFTFSMYMMLWVRQAPGKGLEWVSGISPSGGITTYADSVKGRFTISRDNSKNTLYLQMNSLRAEDTAVYYCARAYSSGWSLPFDYWGQGTLVTVSS

SEQ ID NO: 6916 - protein, 121 aa, Artificial Sequence; identical to SEQ ID NO: 6814
  Description of Artificial Sequence: Synthetic polypeptide

SEQ ID NO: 6917 - protein, 122 aa, Artificial Sequence
  Description of Artificial Sequence: Synthetic polypeptide
EVQLLESGGGLVQPGGSLRLSCAASGFTFSKYPMTWVRQAPGKGLEWVSSISPSGGLTFYADSVKGRFTISRDNSKNTLYLQMNSLRAEDTAVYYCAKARRMRSLWEAFDVWGQGTMVTVSS

SEQ ID NO: 6918 - protein, 121 aa, Artificial Sequence; identical to SEQ ID NO: 6825
  Description of Artificial Sequence: Synthetic polypeptide

SEQ ID NO: 6919 - protein, 121 aa, Artificial Sequence; identical to SEQ ID NO: 6825
  Description of Artificial Sequence: Synthetic polypeptide

SEQ ID NO: 6920 - protein, 123 aa, Artificial Sequence
  Description of Artificial Sequence: Synthetic polypeptide
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 6921 - protein, 116 aa, Artificial Sequence
  Description of Artificial Sequence: Synthetic polypeptide
QVQLQESGAELSKPGASVKMSCKASGYTFTSYWLHWIKQRPGQGLEWIGYIYPRNDYTEYNQNFKDKATLTADKSSSTAYMQLSSLTSEDSAVYYCARRDITTFYWGQGTTLTVSS

SEQ ID NO: 6922 - protein, 116 aa, Artificial Sequence
  Description of Artificial Sequence: Synthetic polypeptide
QVQLQQSGAEVKKPGSSVKVSCKASGYTFTSYWLHWVRQAPGQGLEWIGYIYPRNDYTEYNQNFKDKATITADESTNTAYMELSSLRSEDTAFYFCARRDITTFYWGQGTTVTVSS

SEQ ID NO: 6923 - protein, 123 aa, Artificial Sequence
  Description of Artificial Sequence: Synthetic polypeptide
EVQLVESGGGLVKPGGSLKLSCAASGFAFSIYDMSWVRQTPEKRLEWVAYISSGGGTTYYPDTVKGRFTISRDNAKNTLYLQMSSLKSEDTAMYYCARHSGYGSSYGVLFAYWGQGTLVTVSA

SEQ ID NO: 6924 - protein, 123 aa, Artificial Sequence
  Description of Artificial Sequence: Synthetic polypeptide
QVQLVQSGAEVKKPGSSVKVSCKASGFTFSIYDMSWVRQAPGQGLEWVAYISSGGGTTYYPDTVKGRFTITADESTNTAYMELSSLRSEDTAFYFCARHSGYGSSYGVLFAYWGQGTLVTVSS

SEQ ID NO: 6925 - protein, 106 aa, Artificial Sequence
  Description of Artificial Sequence: Synthetic polypeptide
PVQLVQSGAEVKKPGSSVKVSCKASGGTFSRSAIIWVRQAPGQGLEWMGGIVPMFGPPNYAQKFQGRVTITADESTNTAYMELSSLRSEDTAFYFCAGGYGIYSPE

SEQ ID NO: 6926 - protein, 449 aa, Artificial Sequence
  Description of Artificial Sequence: Synthetic polypeptide
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6927 - protein, 113 aa, Artificial Sequence
  Description of Artificial Sequence: Synthetic polypeptide
EVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVSS

SEQ ID NO: 6928 - protein, 119 aa, Artificial Sequence
  Description of Artificial Sequence: Synthetic polypeptide
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSS

SEQ ID NO: 6929 - protein, 456 aa, Artificial Sequence
  Description of Artificial Sequence: Synthetic polypeptide
EIQLQQSGPELVKPGASVKVSCKASGYAFTSYNMYWVKQSHGKSLEWIGYIDPYNGVTSYNQKFKGKATLTVDKSSSTAYMHLNSLTSEDSAVYYCARGGGSIYYAMDYWGQGTSVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 6930 - protein, 118 aa, Artificial Sequence
  Description of Artificial Sequence: Synthetic polypeptide
QVQLQQPGAELVKPGASVKMSCKASGYTFTSYNMHWIKQTPGQGLEWIGDIYPGNGDTSYNQKFKGKATLTADKSSSTVYMQLSSLTSEDSAVYYCARVGGAFPMDYWGQGTSVTVSS

SEQ ID NO: 6931 - protein, 118 aa, Artificial Sequence
  Description of Artificial Sequence: Synthetic polypeptide
QVQLVQSGAEVKKPGESLKISCKGSGYTFTSYNMHWVRQMPGKGLEWMGDIYPGNGDTSYNQKFKGQVTISADKSISTVYLQWSSLKASDTAMYYCARVGGAFPMDYWGQGTTVTVSS

SEQ ID NO: 6932 - protein, 118 aa, Artificial Sequence
  Description of Artificial Sequence: Synthetic polypeptide
QVQLVQSGAEVKKPGASVKVSCKASGYTFTSYNMHWVRQAPGQGLEWIGDIYPGNGDTSYNQKFKGRATMTADKSTSTVYMELSSLRSEDTAVYYCARVGGAFPMDYWGQGTLVTVSS

SEQ ID NO: 6933 - protein, 118 aa, Artificial Sequence
  Description of Artificial Sequence: Synthetic polypeptide
QVQLVQSGAEVKKPGASVKVSCKASGYTFTSYNMHWVRQAPGQGLEWIGDIYPGSGDTSYNQKFKGRATMTADKSTSTVYMELSSLRSEDTAVYYCARVGGAFPMDYWGQGTLVTVSS

SEQ ID NO: 6934 - protein, 118 aa, Artificial Sequence
  Description of Artificial Sequence: Synthetic polypeptide
QVQLVQSGAEVKKPGASVKVSCKASGYTFTSYNMHWVRQAPGQGLEWIGDIYPGQGDTSYNQKFKGRATMTADKSTSTVYMELSSLRSEDTAVYYCARVGGAFPMDYWGQGTLVTVSS

SEQ ID NO: 6935 - protein, 118 aa, Artificial Sequence
  Description of Artificial Sequence: Synthetic polypeptide
QVQLVQSGAEVKKPGASVKVSCKASGYTFTSYNMHWIRQAPGQGLEWIGDIYPGNGDTSYNQKFKGRATLTADKSTSTVYMELSSLRSEDTAVYYCARVGGAFPMDYWGQGTLVTVSS

SEQ ID NO: 6936 - protein, 118 aa, Artificial Sequence
  Description of Artificial Sequence: Synthetic polypeptide
QVQLVQSGAEVKKPGASVKVSCKASGYTFTSYNMHWIRQAPGQGLEWIGDIYPGSGDTSYNQKFKGRATLTADKSTSTVYMELSSLRSEDTAVYYCARVGGAFPMDYWGQGTLVTVSS

SEQ ID NO: 6937 - protein, 118 aa, Artificial Sequence
  Description of Artificial Sequence: Synthetic polypeptide
QVQLVQSGAEVKKPGASVKVSCKASGYTFTSYNMHWIRQAPGQGLEWIGDIYPGQGDTSYNQKFKGRATLTADKSTSTVYMELSSLRSEDTAVYYCARVGGAFPMDYWGQGTLVTVSS

SEQ ID NO: 6938 - protein, 118 aa, Artificial Sequence
  Description of Artificial Sequence: Synthetic polypeptide
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSS

SEQ ID NO: 6939 - protein, 118 aa, Artificial Sequence
  Description of Artificial Sequence: Synthetic polypeptide
EVQLVQSGAEVKKPGESLKISCKGSGYTFTSYNMHWVRQMPGKGLEWMGDIYPGNGDTSYNQKFKGQVTISADKSISTVYLQWSSLKASDTAMYYCARVGGAFPMDYWGQGTTVTVSS

SEQ ID NO: 6940 - protein, 118 aa, Artificial Sequence
  Description of Artificial Sequence: Synthetic polypeptide
QVQLVQSGAEVKKPGSSVKVSCKASGYTFTSYNMHWVRQAPGQGLEWMGDIYPGSGDTSYNQKFKGRVTITADKSTSTVYMELSSLRSEDTAVYYCARVGGAFPMDYWGQGTTVTVSS

SEQ ID NO: 6941 - protein, 118 aa, Artificial Sequence
  Description of Artificial Sequence: Synthetic polypeptide
QVQLVQSGAEVKKPGSSVKVSCKASGYTFTSYNMHWVRQAPGQGLEWMGDIYPGQGDTSYNQKFKGRVTITADKSTSTVYMELSSLRSEDTAVYYCARVGGAFPMDYWGQGTTVTVSS

SEQ ID NO: 6942 - protein, 118 aa, Artificial Sequence
  Description of Artificial Sequence: Synthetic polypeptide
EVQLVQSGAEVKKPGESLKISCKGSGYTFTSYNMHWVRQMPGKGLEWMGDIYPGSGDTSYNQKFKGQVTISADKSISTVYLQWSSLKASDTAMYYCARVGGAFPMDYWGQGTTVTVSS

SEQ ID NO: 6943 - protein, 118 aa, Artificial Sequence
  Description of Artificial Sequence: Synthetic polypeptide
EVQLVQSGAEVKKPGESLKISCKGSGYTFTSYNMHWVRQMPGKGLEWMGDIYPGQGDTSYNQKFKGQVTISADKSISTVYLQWSSLKASDTAMYYCARVGGAFPMDYWGQGTTVTVSS

SEQ ID NO: 6944 - protein, 118 aa, Artificial Sequence; identical to SEQ ID NO: 6934
  Description of Artificial Sequence: Synthetic polypeptide

SEQ ID NO: 6945 - protein, 118 aa, Artificial Sequence
  Description of Artificial Sequence: Synthetic polypeptide
QVQLVQSGAEVKKPGASVKVSCKASGYTFTSYNMHWVRQAPGQGLEWMGDIYPGQGDTSYNQKFKGRVTMTRDTSTSTVYMELSSLRSEDTAVYYCARVGGAFPMDYWGQGTTVTVSS

SEQ ID NO: 6946 - protein, 119 aa, Artificial Sequence
  Description of Artificial Sequence: Synthetic polypeptide
QVQLVQSGAEVKKPGASVKVSCKASGYTFTTYWIHWVRQAPGQRLEWMGEINPNNGRINYNEKFKTRVTITRDTSASTAYMELSSLRSEDTAVYYCARVGVMITTFPYWGQGTLVTVSS

SEQ ID NO: 6947 - protein, 119 aa, Artificial Sequence
  Description of Artificial Sequence: Synthetic polypeptide
QVQLVQSGAEVKKPGASVKVSCKASGYTFTTYWIHWVRQAPGQGLEWMGEINPNNGRINYNEKFKTRVTMTRDTSISTAYMELSRLRSDDTAVYYCARVGVMITTFPYWGQGTLVTVSS

SEQ ID NO: 6948 - protein, 119 aa, Artificial Sequence
  Description of Artificial Sequence: Synthetic polypeptide
QVQLVQSGAEVKKPGASVKVSCKASGYTFTTYWIHWVRQATGQGLEWMGEINPNNGRINYNEKFKTRVTMTRNTSISTAYMELSSLRSEDTAVYYCARVGVMITTFPYWGQGTLVTVSS

SEQ ID NO: 6949 - protein, 119 aa, Artificial Sequence
  Description of Artificial Sequence: Synthetic polypeptide
QVQLVQSGAEVKKPGSSVKVSCKASGGTFSTYWIHWVRQAPGQGLEWMGEINPNNGRINYNEKFKTRVTITADESTSTAYMELSSLRSEDTAVYYCARVGVMITTFPYWGRGTLVTVSS

SEQ ID NO: 6950 - protein, 119 aa, Artificial Sequence
  Description of Artificial Sequence: Synthetic polypeptide
QVQLVQSGAEVKKPGASVKVSCKASGYTFTTYWIHWVRQAPGQRLEWMGEINPNNGRINGNEKFKTRVTITRDTSASTAYMELSSLRSEDTAVYYCARVGVMITTFPYWGQGTLVTVSS

SEQ ID NO: 6951 - protein, 119 aa, Artificial Sequence
  Description of Artificial Sequence: Synthetic polypeptide
QVQLVQSGAEVKKPGASVKVSCKASGYTFTTYWIHWVRQAPGQRLEWMGEINPNNGRINYAEKFKTRVTITRDTSASTAYMELSSLRSEDTAVYYCARVGVMITTFPYWGQGTLVTVSS

SEQ ID NO: 6952 - protein, 119 aa, Artificial Sequence
  Description of Artificial Sequence: Synthetic polypeptide
QVQLVQSGAEVKKPGASVKVSCKASGYTFTTYWIHWVRQAPGQRLEWMGEINPNNGRINYNEKGKTRVTITRDTSASTAYMELSSLRSEDTAVYYCARVGVMITTFPYWGQGTLVTVSS

SEQ ID NO: 6953 - protein, 119 aa, Artificial Sequence
  Description of Artificial Sequence: Synthetic polypeptide
QVQLVQSGAEVKKPGASVKVSCKASGYTFTTYWIHWVRQAPGQRLEWMGEINPNNGRINYNEKFKTRVTITRDTSASTAYMELSSLRSEDTAVYYCARVGVIITTFPYWGQGTLVTVSS

SEQ ID NO: 6954 - protein, 138 aa, Artificial Sequence
  Description of Artificial Sequence: Synthetic polypeptide
MGWSYIILFLVATATDVHSQVQLQQPGAELVQPGTSVRLSCKASGYIFTTYWIHWVKQRPGQGLEWIGEINPNNGRINYNEKFKTKATLTVDKSSSTAYMQLSSLTSEDSAVYYCTRVGVMITTFPYWGQGTLVTVSA

SEQ ID NO: 6955 - protein, 216 aa, Artificial Sequence
  Description of Artificial Sequence: Synthetic polypeptide
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 6956 - protein, 229 aa, Artificial Sequence
  Description of Artificial Sequence: Synthetic polypeptide
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 6957 - protein, 120 aa, Artificial Sequence
  Description of Artificial Sequence: Synthetic polypeptide
EVKLEESGGGLVQPGGSMKLSCVASGFIFSNHWMNWVRQSPEKGLEWVAEIRSKSINSATHYAESVKGRFTISRDDSKSAVYLQMTDLRTEDTGVYYCSRNYYGSTYDYWGQGTTLTVSS

SEQ ID NO: 6958 - protein, 117 aa, Artificial Sequence
  Description of Artificial Sequence: Synthetic polypeptide
QVQLKESGPGLVAPSQSLSITCTVSGFSLTDYGVNWVRQPPGKGLEWLGMIWGDGSTDYDSTLKSRLSISKDNSKSQIFLKMNSLQTDDTARYYCAREWHHGPVAYWGQGTLVTVSA

SEQ ID NO: 6959 - protein, 117 aa, Artificial Sequence
  Description of Artificial Sequence: Synthetic polypeptide
QVQLQESGPGLVKPSETLSLTCTVSGGSISDYGVNWIRQPPGKGLEWIGMIWGDGSTDYDSTLKSRVTISVDTSKNQFSLKLSSVTAADTAVYYCAREWHHGPVAYWCQGTLVTVSS

SEQ ID NO: 6960 - protein, 117 aa, Artificial Sequence
  Description of Artificial Sequence: Synthetic polypeptide
EVQLVESGGGLIQPGGSLRLSCAASGFTVSDYGVNWVRQAPGKGLEWVSMIWGDGSTDYDSTLKSRFTISRDNSKNTLYLQMNSLRAEDTAVYYCAREWHHGPVAYWGQGTLVTVSS

SEQ ID NO: 6961 - protein, 117 aa, Artificial Sequence
  Description of Artificial Sequence: Synthetic polypeptide
EVQLQESGPGLVKPSETLSLTCTVSGGSISDYGVNWIRQPPGKGLEWIGMIWGDGSTDYDSTLKSRVTISVDTSKNQFSLKLSSVTAADTAVYYCAREWHHGPVAYWGQGTLVTVSS

SEQ ID NO: 6962 - protein, 117 aa, Artificial Sequence
  Description of Artificial Sequence: Synthetic polypeptide
EVQLQESGPGLVKPSETLSLTCTVSGFSLSDYGVNWVRQPPGKGLEWLGMIWGDGSTDYDSTLKSRLTISKDNSKSQISLKLSSVTAADTAVYYCAREWHHGPVAYWGQGTLVTVSS

SEQ ID NO: 6963 - protein, 117 aa, Artificial Sequence
  Description of Artificial Sequence: Synthetic polypeptide
EVQLQESGPGLVKPSETLSLTCTVSGFSLSDYGVNWIRQPPGKGLEWIGMIWGDGSTDYDSTLKSRVTISKDTSKNQFSLKLSSVTAADTAVYYCAREWHHGPVAYWGQGTLVTVSS

SEQ ID NO: 6964 - protein, 117 aa, Artificial Sequence; identical to SEQ ID NO: 6963
  Description of Artificial Sequence: Synthetic polypeptide

SEQ ID NO: 6965 - protein, 117 aa, Artificial Sequence; identical to SEQ ID NO: 6963
  Description of Artificial Sequence: Synthetic polypeptide

SEQ ID NO: 6966 - protein, 117 aa, Artificial Sequence; identical to SEQ ID NO: 6963
  Description of Artificial Sequence: Synthetic polypeptide

SEQ ID NO: 6967 - protein, 122 aa, Artificial Sequence
  Description of Artificial Sequence: Synthetic polypeptide
EVQLVESGGGLVQPGGSLRLSCAASGFSLSSGAMSWVRQAPGKGLEWVSVIISSGATYYASWAKGRFTISRDNSKNTLYLQMNSLRAEDTAVYYCAKGGPDDSNSMGTFDPWGQGTLVTVSS

SEQ ID NO: 6968 - protein, 122 aa, Artificial Sequence
  Description of Artificial Sequence: Synthetic polypeptide
EVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 6969 - protein, 122 aa, Artificial Sequence
  Description of Artificial Sequence: Synthetic polypeptide
EVQLVESGGGSVQPGGSLRLSCTVSGFSLSSGAMSWVRQAPGKGLEWVGVIISSGATYYASWAKGRFTISKDTSKNTVYLQMNSLRAEDTATYYCARGGPDDSNSMGTFDPWGQGTSVTVSS

SEQ ID NO: 6970 - protein, 118 aa, Artificial Sequence
  Description of Artificial Sequence: Synthetic polypeptide
EVQLVESGGGLVQPGGSLRLSCAASGFTFSNDAISWVRQAPGKGLEWVSYISDWSIRYYANWAQGRFTISRDNSKNTLYLQMNSLRAEDTAVYYCAKGAPGAGDNGIWGQGTLVTVSS

SEQ ID NO: 6971 - protein, 118 aa, Artificial Sequence
  Description of Artificial Sequence: Synthetic polypeptide
EVQLVESGGGSVQPGGSLRLSCTVSGIDLSNDAISWVRQAPGKGLEWVAYISDWSIRYYANWAQGRFTISKDTSKNTVYLQMNSLRAEDTATYYCARGAPGAGDNGIWGQGTTVTVSS

SEQ ID NO: 6972 - protein, 121 aa, Artificial Sequence
  Description of Artificial Sequence: Synthetic polypeptide
EVQLVESGGGLVQPGGSLRLSCAASGFSLSRYGVSWVRQAPGKGLEWVSTIGEAGRAYYANWARSRFTISRDNSKNTLYLQMNSLRAEDTAVYYCAKGEVFNNGWGAFNIWGQGTLVTVSS

SEQ ID NO: 6973 - protein, 121 aa, Artificial Sequence
  Description of Artificial Sequence: Synthetic polypeptide
EVQLVESGGGLVQPGGSLRLSCTVSGFSLSRYGVSWVRQAPGKGLEWVGTIGEAGRAYYANWARSRSTISRDTSKNTVYLQMNSLRAEDTAVYYCARGEVFNNGWGAFNIWGQGTLVTVSS

SEQ ID NO: 6974 - protein, 121 aa, Artificial Sequence
  Description of Artificial Sequence: Synthetic polypeptide
EVQLVESGGGLVQPGGSLRLSCAASGFTFSRYGVSWVRQAPGKGLEWVSAIGETGRAYYANWAKSRFTISRDNSKNTLYLQMNSLRAEDTAVYYCAKGEEFNNGWGAFNIWGQGTLVTVSS

SEQ ID NO: 6975 - protein, 121 aa, Artificial Sequence
  Description of Artificial Sequence: Synthetic polypeptide
EVQLVESGGGSVQPGGSLRLSCTVSGFSLSRYGVSWVRQAPGKGLEWVGAIGETGRAYYANWAKSRSTISRDTSKNTVYLQMNSLRAEDTATYYCARGEEFNNGWGAFNIWGQGTTVTVSS

SEQ ID NO: 6976 - protein, 120 aa, Artificial Sequence
  Description of Artificial Sequence: Synthetic polypeptide
EVQLVESGGGLVQPGGSLRLSCTVSGFSLNSNEISWVRQAPGKGLEWVGYIGNGGMTHYASWAKGRFTISRDTSKNTVYLQMNSLRAEDTAVYYCASSVEYTDLYYLNIWGQGTLVTVSS

SEQ ID NO: 6977 - protein, 120 aa, Artificial Sequence
  Description of Artificial Sequence: Synthetic polypeptide
EVQLVESGGGLVQPGGSLRLSCAASGFSLNSNEISWVRQAPGKGLEWVSYIGNGGMTHYASWAKGRFTISRDNSKNTLYLQMNSLRAEDTAVYYCAKSVEYTDLYYLNIWGQGTLVTVSS

SEQ ID NO: 6978 - protein, 121 aa, Artificial Sequence
  Description of Artificial Sequence: Synthetic polypeptide
EVQLVESGGGLVQPGGSLRLSCAASGFTISRSYWICWVRQAPGKGLEWVSCIYGDNDITPLYANWAKGRFTISRDNSKNTLYLQMNSLRAEDTAVYYCAKLGYADYAYDLWGQGTLVTVSS

SEQ ID NO: 6979 - protein, 121 aa, Artificial Sequence
  Description of Artificial Sequence: Synthetic polypeptide
EVQLVESGGGLVQPGGSLRLSCTASGFTISRSYWICWVRQAPGKGLEWVACIYGDNDITPLYANWAKGRFPVSTDTSKNTVYLQMNSLRAEDTAVYYCARLGYADYAYDLWGQGTLVTVSS

SEQ ID NO: 6980 - protein, 122 aa, Artificial Sequence
  Description of Artificial Sequence: Synthetic polypeptide
EVQLVESGGGLVQPGGSLRLSCAASGFTFSVGYWICWVRQAPGKGLEWVSCIDAGTSGGTYYATWAKGRFTISRDNSKNTLYLQMNSLRAEDTAVYYCAKGVSSNGYYFKLWGQGTLVTVSS

SEQ ID NO: 6981 - protein, 122 aa, Artificial Sequence
  Description of Artificial Sequence: Synthetic polypeptide
EVQLVESGGGSVQPGGSLRLSCTASGFSFSVGYWICWVRQAPGKGLEWVACIDAGTSGGTYYATWAKGRFTISKDTSKNTVYLQMNSLRAEDTATYYCARGVSSNGYYFKLWGQGTTVTVSS

SEQ ID NO: 6982 - protein, 118 aa, Artificial Sequence
  Description of Artificial Sequence: Synthetic polypeptide
EVQLVESGGGLVQPGGSLRLSCAASGFTFRNDAISWVRQAPGKGLEWVSYISDWGIKYYASWVKGRFTISRDNSKNTLYLQMNSLRAEDTAVYYCAKGAPGAGDNGIWGQGTLVTVSS

SEQ ID NO: 6983 - protein, 118 aa, Artificial Sequence
  Description of Artificial Sequence: Synthetic polypeptide
EVQLVESGGGSVQPGGSLRLSCTVSGIDLRNDAISWVRQAPGKGLEWVSYISDWGIKYYASWVKGRFTISKDTSKNTVYLQMNSLRAEDTATYYCARGAPGAGDNGIWGQGTTVTVSS

SEQ ID NO: 6984 - protein, 122 aa, Artificial Sequence
  Description of Artificial Sequence: Synthetic polypeptide
METGLRWLLLVAVLKGVQCQSVEESGGRLVTPGTPLTLTCTASGFSLSNYVMGWVRQAPGKGLEFIGYIAFGIGPYYATWAKGRFSISSTSSTTVDLTMTSLTPEDTATYFCARGDYSGNNI

SEQ ID NO: 6985 - protein, 120 aa, Artificial Sequence
  Description of Artificial Sequence: Synthetic polypeptide
METGLRWLLLVAVLKGVQCQSVEESGGRLVTPGTPLTLTCTVSGFSLSIYWMTWVRQAPGKGLEWIGVISTDGSAYYATWAKGRFTISKTSSTTVDLRITSPTTEDTATYFCAGGGGMDP

SEQ ID NO: 6986 - protein, 120 aa, Artificial Sequence
  Description of Artificial Sequence: Synthetic polypeptide
METGLRWLLLVAVLKGVQCQSVEESGGRLVTPGTPLTLTCTVSGFSLSIYWMTWVRQAPGRGLEWIGVISTDGTTYYANWAKGRFTISKASSTTVDLRITSPTTEDTATYFCAGGGGMDP

SEQ ID NO: 6987 - protein, 120 aa, Artificial Sequence
  Description of Artificial Sequence: Synthetic polypeptide
METGLRWLLLVAVLKGVQCQSVEESGGRLVTPGTPLTLTCTVSGFSLSIYWMTWVRQAPGKGLEWIGVIASDGSTYYASWAKGRFTISKASSTTVDLKIASPTIEDTATYFCAGGGGMDP

SEQ ID NO: 6988 - protein, 128 aa, Artificial Sequence
  Description of Artificial Sequence: Synthetic polypeptide
METGLRWLLLVAVLKGVQCQSVEESGGRLVTPGTPLTLTCTVSGFSLSHYAMGWVRQAPGKGLEWIGIISSNGVTYYATWASGRFTISKTSTTVDLKITSPTTEDTATYFCARGDDTSIIYYIYAFDL

SEQ ID NO: 6989 - protein, 122 aa, Artificial Sequence
  Description of Artificial Sequence: Synthetic polypeptide
METGLRWLLLVAVLKGVQCQSVEESGGRLVTPGTPLTLTCSVSGFSLNNYVMGWVRQAPGKGLEFIGYIAFGIGPYYASWAKGRFTISSTSSTTVDLKMTSLTPEDTATYFCARGDYSGNDI

SEQ ID NO: 6990 - protein, 124 aa, Artificial Sequence
  Description of Artificial Sequence: Synthetic polypeptide
METGLRWLLLVAVLKGVQCQSVEESGGRLVTPGTPLTLTCTVSGIDLSSYAMGWVRQAPGKGLEYIGYILSSGITYYASWARGRFTISKTSSTTVDLKMTSLTTEDTATYFCARNGNYNSGTDI

SEQ ID NO: 6991 - protein, 124 aa, Artificial Sequence
  Description of Artificial Sequence: Synthetic polypeptide
METGLRWLLLVAVLKGVQCQSVEESGGRLVTPGTPLTLTCTVSGFSLSSYAMGWVRQAPGKGLEYIGYIGSSGITYYTSWARGRFTISKPSSTTVDLKMTSLTTEDTATYFCARNGNYNSGTDI

SEQ ID NO: 6992 - protein, 121 aa, Artificial Sequence
  Description of Artificial Sequence: Synthetic polypeptide
METGLRWLLLVAVLKGVQCQSVEESGGRLVSPGTPLTLTCTVSGIDLSSYGMGWVRQAPGKGLEYIGYMIASGITYYAAWAKGRFTISKTSSTTVDLKITSPTTEDTATYFCARNYYGMDP

SEQ ID NO: 6993 - protein, 125 aa, Artificial Sequence
  Description of Artificial Sequence: Synthetic polypeptide
METGLRWLLLVAVLKGVQCQSLEESGGRLVKPDETLTITCTVSGIDLNNYNMGWVRQAPGKGLEYIGYILGSGITYYATWAKGRFTISKTSSTTVDLKMTSLTTEDTATYFCAGSIYYRGYGMDP

SEQ ID NO: 6994 - protein, 124 aa, Artificial Sequence
  Description of Artificial Sequence: Synthetic polypeptide
METGLRWLLLVAVLKGVQCQSLEESGGRLVTPGGSLTLTCTVSGIDLSSYAMGWVRQAPGKGLEYIGYVLGSGITYYASWARGRFTISKTSSTTVDLKMTSLTTEDTATYFCVRNDNYNSGTDI

SEQ ID NO: 6995 - protein, 124 aa, Artificial Sequence
  Description of Artificial Sequence: Synthetic polypeptide
METGLRWLLLVAVLKGVQCQSVEESGGRLVTPGTPLTLTCTVSGIDLSSYAMGWVRQAPGKGLEYIGYILSSGITYYASWARGRFTISKTSSTTVDLKMTSLTTEDTATYFCVRNGNYNVGTDI

SEQ ID NO: 6996 - protein, 122 aa, Artificial Sequence
  Description of Artificial Sequence: Synthetic polypeptide
METGLRWLLLVAVLKGVQCQSVEESGGRLVTPGTPLTLTCSVSGFSLNNYIMGWVRQAPGKGLEFIGYIAFGIGPYYASWAKGRFTSSSTSSTTVDLKMTSLTPEDTATYFCARGDVSGNDI

SEQ ID NO: 6997 - protein, 121 aa, Artificial Sequence
  Description of Artificial Sequence: Synthetic polypeptide
METGLRWLLLVAVLKGVQCQSVEESGGRLVTPGTPLTLTCTVSGFSLSTYNMGWVRQAPGKGLEYIGYVLGSGITYYASWAKGRFTISKTSTTVDLEITSPTTEDTATYFCARDAGGRASL

SEQ ID NO: 6998 - protein, 124 aa, Artificial Sequence
  Description of Artificial Sequence: Synthetic polypeptide
METGLRWLLLVAVLKGVQCQSVEESGGRLVTPGTPLTLTCTVSGIDLNSYAMGWVRQAPGKGLEYIGYILSSGITYYATWAKGRFTISKTSSTTVDLKMTSLTTEDTATYFCVRNGNYNSGTDI

SEQ ID NO: 6999 - protein, 127 aa, Artificial Sequence
  Description of Artificial Sequence: Synthetic polypeptide
METGLRWLLLVAVFKGVQCQSVEESGGRLVTPGTPLTLTCTVSGFSLSTYTMGWVRQAPGKGLEYIGYISYGGLAYYATWVNGRFTISKTSTTVDLKMTSLTASDTATYFCARAASGAWGHAYGLDL

SEQ ID NO: 7000 - protein, 121 aa, Artificial Sequence
  Description of Artificial Sequence: Synthetic polypeptide
METGLRWLLLVAVLKGVQCQSVEESGGRLVSPGTPLTLTCTVSGIDLSSYGMGWVRQAPGKGLDYIGYMLPSGITYYAAWAKGRFTISKTSSTTVDLKITSPTTEDTATYFCARNYYGMDP

SEQ ID NO: 7001 - protein, 127 aa, Artificial Sequence
  Description of Artificial Sequence: Synthetic polypeptide
METGLRWLLLVAVLKGVQCQSVEESGGRLVTPGTPLTLTCKVSGFSLSSYDMTWVRQAPGKGLEWIGYIWNDGSTAYASWATGRFTISKTSTTVDLKIASPTTEDTATYFCARGPVFATTLGYYFTI

SEQ ID NO: 7002 - protein, 129 aa, Artificial Sequence
  Description of Artificial Sequence: Synthetic polypeptide
METGLRWLLLVAVLKGVQCQEQLEESGGDLVKPGASLTLTCKASGFSFSSGYYMGWVRQAPGKGLQYIGYIDYGGSAYYASWAKGRFTISKTSSTTVTLQMTSLTAADTATFFCTRRDYTGGVVRGLDL

SEQ ID NO: 7003 - protein, 123 aa, Artificial Sequence
  Description of Artificial Sequence: Synthetic polypeptide
METGLRWLLLVAVLKGVQCQSVEESGGRLVTPGTPLTLTCTASGFSLNNYYMTWVRQAPGKGLESIGYFASGGGTYYANWAKGRFTISKTSTTVDLKITSPTTDDTATYFCARGGAYLGTGSL

SEQ ID NO: 7004 - protein, 123 aa, Artificial Sequence
  Description of Artificial Sequence: Synthetic polypeptide
METGLRWLLLVAVLKGVQCQSVEESGGRLVTPGTPLTLTCTVAGFSLSTYGVTWVRQAPGKGLESIGYITYGNIKYYATWAKGRFTISKTSTTVDLKMTSPTTEDTATYFCTRYGGSGIGEDL

SEQ ID NO: 7005 - protein, 125 aa, Artificial Sequence
  Description of Artificial Sequence: Synthetic polypeptide
METGLRWLLLVAVLKGVQCQSVEESGGRLVTPGTPLTLTCTVSGFSLSSYYMAWVRQAPGKGLEWIGYIGFGGSTYYATWAKGRVTISRTSTTVDLQITSPTTEDTATYFCARGVYGDFRTGADL

SEQ ID NO: 7006 - protein, 122 aa, Artificial Sequence
  Description of Artificial Sequence: Synthetic polypeptide
METGLRWLLLVAVLKGVQCQSVEESGGRLVTPGTPLTLTCTVSGLSLSTETINWVRQAPGKGLEWIGYIDSSGGTGYANWARGRFTISKTSTTVDLKITSPTTGDTATYFCARGTITTGMNI

SEQ ID NO: 7007 - protein, 120 aa, Artificial Sequence
  Description of Artificial Sequence: Synthetic polypeptide
METGLRWLLLVAVLKGVQCQSVEESGGRLVTPGTPLTLTCAVSGFSLSVYWMTWVRQAPGKGLEWIGTISTDGITVYATWAKGRFTISKTSSTAVDLKLTSPTTEDTATYFCAGGGGMDP

SEQ ID NO: 7008 - protein, 126 aa, Artificial Sequence
  Description of Artificial Sequence: Synthetic polypeptide
METGLRWLLLVAVFKGVQCQSVEESGGRLVTPGTPLTLTCTVSGFSLSSNTISWVRQAPGKGLEWIGYIWRGVSTYYATWAKGRFTISKTSSTTVDLKITGPTTEDTATYFCARDAGDGGGYSLDL

SEQ ID NO: 7009 - protein, 121 aa, Artificial Sequence
  Description of Artificial Sequence: Synthetic polypeptide
METGLRWLLLVAVLKGVQCQSVEESGGRLVTPGTPLTLTCTVSGFSLSSDNMGWVRQAPGKGLEYIGYITYGGFTYYATWAKGRFTISKTSTTVDLKMTSPTTEDTATYFCAREAGGRANV

SEQ ID NO: 7010 - protein, 120 aa, Artificial Sequence
  Description of Artificial Sequence: Synthetic polypeptide
QQLQESGPGLVKPSETLSLTCAVSGFSLSRYGINWVRQAPGSGLEWIGAIGETGRAYYASWAKSRSTISRDTSKNQVSLKMSSVTAADTAVYFCARGELFNNGWGAFNIWGPGTMVTVSS

SEQ ID NO: 7011 - protein, 119 aa, Artificial Sequence [sequence omitted]

SEQ ID NO: 7012 - protein, 122 aa, Artificial Sequence
  Description of Artificial Sequence: Synthetic polypeptide
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSS

SEQ ID NO: 7013 - protein, 117 aa, Artificial Sequence; identical to SEQ ID NO: 5378
  Description of Artificial Sequence: Synthetic polypeptide

SEQ ID NO: 7014 - protein, 117 aa, Artificial Sequence; identical to SEQ ID NO: 6959
  Description of Artificial Sequence: Synthetic polypeptide

SEQ ID NO: 7015 - protein, 117 aa, Artificial Sequence; identical to SEQ ID NO: 6960
  Description of Artificial Sequence: Synthetic polypeptide

SEQ ID NO: 7016 - protein, 117 aa, Artificial Sequence; identical to SEQ ID NO: 6961
  Description of Artificial Sequence: Synthetic polypeptide

SEQ ID NO: 7017 - protein, 117 aa, Artificial Sequence; identical to SEQ ID NO: 6962
  Description of Artificial Sequence: Synthetic polypeptide

SEQ ID NO: 7018 - protein, 117 aa, Artificial Sequence; identical to SEQ ID NO: 6963
  Description of Artificial Sequence: Synthetic polypeptide

SEQ ID NO: 7019 - protein, 117 aa, Artificial Sequence
  Description of Artificial Sequence: Synthetic polypeptide
EVQLVESGGGLVQPGGSLRLSCAASGFTFSDYGVNWVRQAPGKGLEWVSMIWGDGSTDYDSTLKSRFTISRDNSKNTLYLQMNSLRAEDTAVYYCAREWHHGPVAYWGQGTLVTVSS

SEQ ID NO: 7020 - protein, 117 aa, Artificial Sequence
  Description of Artificial Sequence: Synthetic polypeptide
EVQLVESGGGLVQPGGSLRLSCAVSGFTLSDYGVNWVRQAPGKGLEWLGMIWGDGSTDYDSTLKSRLTISKDNSKSTIYLQMNSLRAEDTAVYYCAREWHHGPVAYWGQGTLVTVSS

SEQ ID NO: 7021 - protein, 117 aa, Artificial Sequence
  Description of Artificial Sequence: Synthetic polypeptide
EVQLVESGGGLVQPGGSLRLSCAASGFTLSDYGVNWVRQAPGKGLEWVSMIWGDGSTDYDSTLKSRFTISKDNSKNTLYLQMNSLRAEDTAVYYCAREWHHGPVAYWGQGTLVTVSS

SEQ ID NO: 7022 - protein, 118 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGTHNRKIWGQGTMVTVSS

SEQ ID NO: 7023 - protein, 118 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLVHRYRAIWGQGTMVTVSS

SEQ ID NO: 7024 - protein, 118 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARPYATDTRIWGQGTMVTVSS

SEQ ID NO: 7025 - protein, 121 aa, Artificial Sequence
  Description of Artificial Sequence: Synthetic polypeptide
EVQLVESGGGLVQPGRSLRLSCAASGFTFSSYAMHWVRQAPGKGLEWVAVISYDGSNKYYADSVKGRFTISRDNSKNTLYLQMNSLRAEDTAVYYCAKDQYSVGATTYDYWGQGTLVTVSS

SEQ ID NO: 7026 - protein, 118 aa, Artificial Sequence
  Description of Artificial Sequence: Synthetic polypeptide
EVQLVESGGGLVQPGRSLRLSCAASGFTFSSYAMHWVRQAPGKGLEWVAVISYDGSNKYYADSVKGRFTISRDNSKNTLYLQMNSLRAEDTAVYYCASKRELHSFDYWGQGTLVTVSS

SEQ ID NO: 7027 - protein, 122 aa, Artificial Sequence
  Description of Artificial Sequence: Synthetic polypeptide
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHSGSVGYALYFDYWGQGTLVTVSS

SEQ ID NO: 7028 - protein, 126 aa, Artificial Sequence
  Description of Artificial Sequence: Synthetic polypeptide
QVQLVQSGAEVKKPGTSVKVSCKASGYTFTTYTMHWVRQAPGQRLEWMGWINTGNGNTKYSQKFQDRVTITRDTSASTAYMELSSLKFEDTAVYYCAREGVTIFGDHSYYYGMDVWGQGTTVTVSS

SEQ ID NO: 7029 - protein, 123 aa, Artificial Sequence
  Description of Artificial Sequence: Synthetic polypeptide
EVQLVESGGGVVKPGESLRLLCTASGLSFNKYSINWVRQAPGGGLEWVSSIESGSGHIYYADSLEGRFTISRDNAKNSVTLEMNSLRVEDTALYYCVSGPEDKWLLQLYFESWGQGTLVTVSS

SEQ ID NO: 7030 - protein, 118 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGWRGGSFMDVWGQGTTVTVSS

SEQ ID NO: 7031 - protein, 121 aa, Artificial Sequence
  Description of Artificial Sequence: Synthetic polypeptide
EVQLVESGGGLVQPGGSLRLSCAASGFTFSSYAMTWVRQAPGKGLEWVSVISGGGGTTYYADSVKGRFTISRDNSKNTLYLQMSSLRAEDTAVYYCAKGYSSGWPYYFDYWGQGTLVTVSS

SEQ ID NO: 7032 - protein, 122 aa, Artificial Sequence
  Description of Artificial Sequence: Synthetic polypeptide
QVQLVQSGAEVKKPGESLKISCKGSGYDFNNYWIGWVRQTPEKGLEWMGIVYPGDHPGDYHIRYGPSFQGQVTISADRSITTAYLQWRNLKASDTAMYYCARLGSSKDLDYWGQGTLVTVSS

SEQ ID NO: 7033 - protein, 119 aa, Artificial Sequence
  Description of Artificial Sequence: Synthetic polypeptide
QVQLQESGPGLMKPSQTLSLTCTVSGDSITRGSSYWSWIRQSDGKGLEWIGHIYSGGDTDYNPALKSRVTISADASRGQFLLRLTSMTAADTAVYYCARDRGAYGMDVWGQGTTVTVSS

SEQ ID NO: 7034 - protein, 126 aa, Artificial Sequence
  Description of Artificial Sequence: Synthetic polypeptide
QVQLVESGGGVVQPGRSRRLSCAASGFAFRNYGMHWVRQAPGKGLEWVAFISQNGGKKYYADSVTGRFTVSRDNSKNTLYLQINSLTTDDTAVFYCARSGSGSWGYSDFPGPFDHWGQGSLVTVSS

SEQ ID NO: 7035 - protein, 120 aa, Artificial Sequence
  Description of Artificial Sequence: Synthetic polypeptide
QVQLVESGGGVVQPGGSLKLSCVASGFTFSAYAMNWVRLVPGKGLEWVSGISGNGYSTFYPDSVQGRFTVSRDNSKNTLFLQIDRLTGGDTAIYYCAKVQTTVITPFQNWGQGTLVTVSS

SEQ ID NO: 7036 - protein, 112 aa, Artificial Sequence
  Description of Artificial Sequence: Synthetic polypeptide
EVQLVEIGGGLIQPGRSLRLSCAASGFTFSSYAMHWVRQAPGKGLEWVAVISYDGSKKYYADSVKGRFTISRDNSKNTVHLQMNSLRVEDTAVYYCALLSRPHYGLDVWGQG

SEQ ID NO: 7037 - protein, 96 aa, Artificial Sequence
  Description of Artificial Sequence: Synthetic polypeptide
EVQLVESGGGLVQPGGSLRLSCAASGFFITNNYWGWVRQAPGKGLEWVGYISYSGSTSYNPSLKSRFTISRDTSKNTFYLQMNSLRAEDTAVYYCA

SEQ ID NO: 7038 - protein, 118 aa, Artificial Sequence; identical to SEQ ID NO: 5356
  Description of Artificial Sequence: Synthetic polypeptide

SEQ ID NO: 7039 - protein, 141 aa, Artificial Sequence
  Description of Artificial Sequence: Synthetic polypeptide
MELGLSWIFLLAILKGVQCEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 7040 - protein, 121 aa, Artificial Sequence [sequence omitted]

SEQ ID NO: 7041 - protein, 120 aa, Artificial Sequence
  Description of Artificial Sequence: Synthetic polypeptide
QVQLKQSRPGPVQPSQSLSITCTVSGFSLPNYGVHWVRQPPGKGLEWLGVIWSGGSTDYNAAFKSRLSISKDNSKSQVFFKMNSLQADDTAIYYCARNFYSKYDYAMDYWGQGTSVTVSS

SEQ ID NO: 7042 - protein, 113 aa, Artificial Sequence
  Description of Artificial Sequence: Synthetic polypeptide
QVQLQQPGSVLVRPGASVKLSCKASGYTFTSYWMHWVKQRPGQGLEWIGNINPNSGSTNYNEKFKGKATLTVDTSSSTAYMDLSSLTSEDSAVYYCARLGDYWGQGTTLTVSS

SEQ ID NO: 7043 - protein, 363 aa, Artificial Sequence
  Description of Artificial Sequence: Synthetic polypeptide
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSS

SEQ ID NO: 7044 - protein, 118 aa, Artificial Sequence [sequence omitted]

SEQ ID NO: 7045 - protein, 140 aa, Artificial Sequence
  Description of Artificial Sequence: Synthetic polypeptide
MGWSLILLFLVAVATRVLSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSA

SEQ ID NO: 7046 - protein, 447 aa, Artificial Sequence
  Description of Artificial Sequence: Synthetic polypeptide
EVQLVESGGGLVQPGGSLRLSCAVSGYSITSGYSWNWIRQAPGKGLEWVASITYDGSTNYADSVKGRFTISRDDSKNTFYLQMNSLRAEDTAVYYCARGSHYFGHWHFAVWGQGTLVTVSSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7047 - protein, 123 aa, Artificial Sequence
  Description of Artificial Sequence: Synthetic polypeptide
QVQLVESGGGVVQPGRSLRLSCAASGFTFSSYGMHWVRQAPGKELEWVAVISYDGSIKYYADSVKGRFTISRDNSKNTLYLQMNSLRAEDTAVYYCARTGEYSGYDTPASPDWGQGTTVTVSS

SEQ ID NO: 7048 - protein, 123 aa, Artificial Sequence
  Description of Artificial Sequence: Synthetic polypeptide
EVQLVESGGGLVKPGGSLKLSCAASGFAFSIYDMSWVRQTPEKRLEWVAYISSGGGTTYYPDTVKGRFTISRDNAKNTLYLQMSSLKSEDTAMYYCARHSGYGTHWGVLFAYWGQGTLVTVSA

SEQ ID NO: 7049 - protein, 121 aa, Artificial Sequence [sequence omitted]

SEQ ID NO: 7050 - protein, 119 aa, Artificial Sequence [sequence omitted]

SEQ ID NO: 7051 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSHIGPSGGITKYADSVKGRFTISRDNSKNTLYLQMNSLRAEDTATYYCAREGHNDWYFDLWGRGTLVTVSS

SEQ ID NO: 7052 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSFIGPSGGITKYADSVKGRFTISRDNSKNTLYLQMNSLRAEDTATYYCAREGHNDWYFDLWGRGTLVTVSS

SEQ ID NO: 7053 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSLIGPSGGITKYADSVKGRFTISRDNSKNTLYLQMNSLRAEDTATYYCAREGHNDWYFDLWGRGTLVTVSS

SEQ ID NO: 7054 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSMIGPSGGITKYADSVKGRFTISRDNSKNTLYLQMNSLRAEDTATYYCAREGHNDWYFDLWGRGTLVTVSS

SEQ ID NO: 7055 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGLSGGITKYADSVKGRFTISRDNSKNTLYLQMNSLRAEDTATYYCAREGHNDWYFDLWGRGTLVTVSS

SEQ ID NO: 7056 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGSSGGITKYADSVKGRFTISRDNSKNTLYLQMNSLRAEDTATYYCAREGHNDWYFDLWGRGTLVTVSS

SEQ ID NO: 7057 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGTSGGITKYADSVKGRFTISRDNSKNTLYLQMNSLRAEDTATYYCAREGHNDWYFDLWGRGTLVTVSS

SEQ ID NO: 7058 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGWSGGITKYADSVKGRFTISRDNSKNTLYLQMNSLRAEDTATYYCAREGHNDWYFDLWGRGTLVTVSS

SEQ ID NO: 7059 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDVYFDLWGRGTLVTVSS

SEQ ID NO: 7060 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDHYFDLWGRGTLVTVSS

SEQ ID NO: 7061 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDSYFDLWGRGTLVTVSS

SEQ ID NO: 7062 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDQYFDLWGRGTLVTVSS

SEQ ID NO: 7063 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGGTKYADSVKGRFTISRDNSKNTLYLQMNSLRAEDTATYYCAREGHNDWYFDLWGRGTLVTVSS

SEQ ID NO: 7064 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGMTKYADSVKGRFTISRDNSKNTLYLQMNSLRAEDTATYYCAREGHNDWYFDLWGRGTLVTVSS

SEQ ID NO: 7065 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGNTKYADSVKGRFTISRDNSKNTLYLQMNSLRAEDTATYYCAREGHNDWYFDLWGRGTLVTVSS

SEQ ID NO: 7066 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGHTKYADSVKGRFTISRDNSKNTLYLQMNSLRAEDTATYYCAREGHNDWYFDLWGRGTLVTVSS

SEQ ID NO: 7067 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGLTKYADSVKGRFTISRDNSKNTLYLQMNSLRAEDTATYYCAREGHNDWYFDLWGRGTLVTVSS

SEQ ID NO: 7068 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGFTKYADSVKGRFTISRDNSKNTLYLQMNSLRAEDTATYYCAREGHNDWYFDLWGRGTLVTVSS

SEQ ID NO: 7069 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSGIGPSGGITKYADSVKGRFTISRDNSKNTLYLQMNSLRAEDTATYYCAREGHNDWYFDLWGRGTLVTVSS

SEQ ID NO: 7070 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSIIGPSGGITKYADSVKGRFTISRDNSKNTLYLQMNSLRAEDTATYYCAREGHNDWYFDLWGRGTLVTVSS

SEQ ID NO: 7071 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSDIGPSGGITKYADSVKGRFTISRDNSKNTLYLQMNSLRAEDTATYYCAREGHNDWYFDLWGRGTLVTVSS

SEQ ID NO: 7072 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDMYFDLWGRGTLVTVSS

SEQ ID NO: 7073 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDLYFDLWGRGTLVTVSS

SEQ ID NO: 7074 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDTYFDLWGRGTLVTVSS

SEQ ID NO: 7075 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDIYFDLWGRGTLVTVSS

SEQ ID NO: 7076 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGGSGGITKYADSVKGRFTISRDNSKNTLYLQMNSLRAEDTATYYCAREGHNDWYFDLWGRGTLVTVSS

SEQ ID NO: 7077 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGWTKYADSVKGRFTISRDNSKNTLYLQMNSLRAEDTATYYCAREGHNDWYFDLWGRGTLVTVSS

SEQ ID NO: 7078 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGYTKYADSVKGRFTISRDNSKNTLYLQMNSLRAEDTATYYCAREGHNDWYFDLWGRGTLVTVSS

SEQ ID NO: 7079 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGSTKYADSVKGRFTISRDNSKNTLYLQMNSLRAEDTATYYCAREGHNDWYFDLWGRGTLVTVSS

SEQ ID NO: 7080 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGPTKYADSVKGRFTISRDNSKNTLYLQMNSLRAEDTATYYCAREGHNDWYFDLWGRGTLVTVSS

SEQ ID NO: 7081 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGVTKYADSVKGRFTISRDNSKNTLYLQMNSLRAEDTATYYCAREGHNDWYFDLWGRGTLVTVSS

SEQ ID NO: 7082 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGTTKYADSVKGRFTISRDNSKNTLYLQMNSLRAEDTATYYCAREGHNDWYFDLWGRGTLVTVSS

SEQ ID NO: 7083 - protein, 119 aa, Artificial Sequence; identical to SEQ ID NO: 7062
  Description of Artificial Sequence: Synthetic polypeptide

SEQ ID NO: 7084 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGLSGGFTFYADSVKGRFTISRDNSKNTLYLQMNSLRAEDTAVYYCATEGDNDAFDIWGQGTTVTVSS

SEQ ID NO: 7085 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGSSGGFTFYADSVKGRFTISRDNSKNTLYLQMNSLRAEDTAVYYCATEGDNDAFDIWGQGTTVTVSS

SEQ ID NO: 7086 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGTSGGFTFYADSVKGRFTISRDNSKNTLYLQMNSLRAEDTAVYYCATEGDNDAFDIWGQGTTVTVSS

SEQ ID NO: 7087 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGWSGGFTFYADSVKGRFTISRDNSKNTLYLQMNSLRAEDTAVYYCATEGDNDAFDIWGQGTTVTVSS

SEQ ID NO: 7088 - protein, 118 aa, Artificial Sequence
  Description of Artificial Sequence: Synthetic polypeptide
EVQLLESGGGLVQPGGSLRLSCAASGFTFSAYEMKWVRQAPGKGLEWVSVIGGSGGFTFYADSVKGRFTISRDNSKNTLYLQMNSLRAEDTAVYYCATEGDNDAFDIWGQGTTVTVSS

SEQ ID NO: 7089 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSHIGPSGGITKYADSVKGRFTISRDNSKNTLYLQMNSLRAEDTATYYCAREGTYDWYLDLWGRGTLVTVSS

SEQ ID NO: 7090 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSFIGPSGGITKYADSVKGRFTISRDNSKNTLYLQMNSLRAEDTATYYCAREGTYDWYLDLWGRGTLVTVSS

SEQ ID NO: 7091 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSLIGPSGGITKYADSVKGRFTISRDNSKNTLYLQMNSLRAEDTATYYCAREGTYDWYLDLWGRGTLVTVSS

SEQ ID NO: 7092 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSMIGPSGGITKYADSVKGRFTISRDNSKNTLYLQMNSLRAEDTATYYCAREGTYDWYLDLWGRGTLVTVSS

SEQ ID NO: 7093 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGLSGGITKYADSVKGRFTISRDNSKNTLYLQMNSLRAEDTATYYCAREGTYDWYLDLWGRGTLVTVSS

SEQ ID NO: 7094 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGSSGGITKYADSVKGRFTISRDNSKNTLYLQMNSLRAEDTATYYCAREGTYDWYLDLWGRGTLVTVSS

SEQ ID NO: 7095 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGTSGGITKYADSVKGRFTISRDNSKNTLYLQMNSLRAEDTATYYCAREGTYDWYLDLWGRGTLVTVSS

SEQ ID NO: 7096 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGWSGGITKYADSVKGRFTISRDNSKNTLYLQMNSLRAEDTATYYCAREGTYDWYLDLWGRGTLVTVSS

SEQ ID NO: 7097 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDVYLDLWGRGTLVTVSS

SEQ ID NO: 7098 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDHYLDLWGRGTLVTVSS

SEQ ID NO: 7099 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDSYLDLWGRGTLVTVSS

SEQ ID NO: 7100 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDQYLDLWGRGTLVTVSS

SEQ ID NO: 7101 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGGTKYADSVKGRFTISRDNSKNTLYLQMNSLRAEDTATYYCAREGTYDWYLDLWGRGTLVTVSS

SEQ ID NO: 7102 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGMTKYADSVKGRFTISRDNSKNTLYLQMNSLRAEDTATYYCAREGTYDWYLDLWGRGTLVTVSS

SEQ ID NO: 7103 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGNTKYADSVKGRFTISRDNSKNTLYLQMNSLRAEDTATYYCAREGTYDWYLDLWGRGTLVTVSS

SEQ ID NO: 7104 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGHTKYADSVKGRFTISRDNSKNTLYLQMNSLRAEDTATYYCAREGTYDWYLDLWGRGTLVTVSS

SEQ ID NO: 7105 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGLTKYADSVKGRFTISRDNSKNTLYLQMNSLRAEDTATYYCAREGTYDWYLDLWGRGTLVTVSS

SEQ ID NO: 7106 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGFTKYADSVKGRFTISRDNSKNTLYLQMNSLRAEDTATYYCAREGTYDWYLDLWGRGTLVTVSS

SEQ ID NO: 7107 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSGIGPSGGITKYADSVKGRFTISRDNSKNTLYLQMNSLRAEDTATYYCAREGTYDWYLDLWGRGTLVTVSS

SEQ ID NO: 7108 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSIIGPSGGITKYADSVKGRFTISRDNSKNTLYLQMNSLRAEDTATYYCAREGTYDWYLDLWGRGTLVTVSS

SEQ ID NO: 7109 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSDIGPSGGITKYADSVKGRFTISRDNSKNTLYLQMNSLRAEDTATYYCAREGTYDWYLDLWGRGTLVTVSS

SEQ ID NO: 7110 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDMYLDLWGRGTLVTVSS

SEQ ID NO: 7111 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDLYLDLWGRGTLVTVSS

SEQ ID NO: 7112 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDTYLDLWGRGTLVTVSS

SEQ ID NO: 7113 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGTYDIYLDLWGRGTLVTVSS

SEQ ID NO: 7114 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGGSGGITKYADSVKGRFTISRDNSKNTLYLQMNSLRAEDTATYYCAREGTYDWYLDLWGRGTLVTVSS

SEQ ID NO: 7115 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGWTKYADSVKGRFTISRDNSKNTLYLQMNSLRAEDTATYYCAREGTYDWYLDLWGRGTLVTVSS

SEQ ID NO: 7116 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGYTKYADSVKGRFTISRDNSKNTLYLQMNSLRAEDTATYYCAREGTYDWYLDLWGRGTLVTVSS

SEQ ID NO: 7117 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGSTKYADSVKGRFTISRDNSKNTLYLQMNSLRAEDTATYYCAREGTYDWYLDLWGRGTLVTVSS

SEQ ID NO: 7118 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGPTKYADSVKGRFTISRDNSKNTLYLQMNSLRAEDTATYYCAREGTYDWYLDLWGRGTLVTVSS

SEQ ID NO: 7119 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGVTKYADSVKGRFTISRDNSKNTLYLQMNSLRAEDTATYYCAREGTYDWYLDLWGRGTLVTVSS

SEQ ID NO: 7120 - protein, 119 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGTTKYADSVKGRFTISRDNSKNTLYLQMNSLRAEDTATYYCAREGTYDWYLDLWGRGTLVTVSS

SEQ ID NO: 7121 - protein, 119 aa, Artificial Sequence; identical to SEQ ID NO: 7100
  Description of Artificial Sequence: Synthetic polypeptide

SEQ ID NO: 7122 - protein, 77 aa, Artificial Sequence
  Description of Artificial Sequence: Synthetic polypeptide
VVSGGSVSSGSYYWSWIRQPPGKGLEWIGYIYYSGSTNYNPSLKSRVTISVDTSKNQFSLKLSSVTAADTAVYYCAR

SEQ ID NO: 7123 - DNA, 561 bp, Artificial Sequence
  Description of Artificial Sequence: Synthetic polynucleotide
aattccctggaatcgattcccagttcctcacattcagtcagcactgaacacggacccctcaccatgaactccgggctcagcctgattttccttgtccttgttttaaaaggtgtccaatgtgaagtgattctggtggagtctgggggagccttagtggagcctggagggtccctgaaactctcctgttcagcctctcactttcagtaactatggattgccatgtcttgggttcgtcagactccggagaagaggctggagtgggtcgcagccattagtgatcatagtactaacacctactatccagacagtgtgaaggggcgattcactatctccagagacaatgccaagaacaccctgtacctacaaatgaacagtctgaggtctgaggacacggccatttattactgtgaaagaaagtacggtggtgactacgacccctttggccaaggcaccactctcacagtctcctcagactattgggccaaaacaacagccccatcggtctatccactggcccctgtgtgtggagatacaactggctcctcggtgactctaggatgc

SEQ ID NO: 7124 - protein, 121 aa, Artificial Sequence
  Description of Artificial Sequence: Synthetic polypeptide
EVQLLESGGGLVQPGGSLRLSCAASGFTFSNAWMSWVRQAPGKGLEWVSSISVGGHRTYYADSVKGRSTISRDNSKNTLYLQMNSLRAEDTAVYYCARIRVGPSGGAFDYWGQGTLVTVSS

SEQ ID NO: 7125 - protein, 125 aa, Artificial Sequence
  Description of Artificial Sequence: Synthetic polypeptide
EVQLVESGGGLVQPGGSLRLSCAASGYSFTGHWMNWVRQAPGKGLEWVGIMIHPSDSETRYNQKFKDIRFTISVDKSKNTLYLQMNSLRAEDTAVYYCARIGIYFYGTTYFDYIWGQGTLVTVSS

SEQ ID NO: 7126 - protein, 139 aa, Artificial Sequence
  Description of Artificial Sequence: Synthetic polypeptide
MRVLILLWLFTAFPGILSDVQLQESGPVLVKPSQSLSLTCTVTGYSITSDHAWSWIRQFPGNKLEWMGYISYSGITTYNPSLKSRISITRDTRDTSNQFFLQLNSVTTGDTSTYYCARSLARTAMDYWGQGTTSVTVSS

SEQ ID NO: 7127 - protein, 121 aa, Artificial Sequence
  Description of Artificial Sequence: Synthetic polypeptide
VQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSS

SEQ ID NO: 7128 - protein, 122 aa, Artificial Sequence
  Description of Artificial Sequence: Synthetic polypeptide
EVQLVESGGGLVQPGGSLRLSCAASGYSFTGHWMNWVRQAPGKGLEWVGMIHPSDSETRYNQKFKDRFTISVDKSKNTLYLQMNSLRAEDTAVYYCARGIYFYGTFFYFDYWGQGTLVTVSS

SEQ ID NO: 7129 - protein, 119 aa, Artificial Sequence
  Description of Artificial Sequence: Synthetic polypeptide
QVQLVQSGAEVKKPGSSVKVSCKASGGTFSSYGISWVRQAPGQGLEWMGGIIPIFGTANYAQKFQGRVTITADESTSTAYMELSSLRSEDTAVYYCARYDGIYGELDFWGQGTLVTVSS

SEQ ID NO: 7130 - protein, 119 aa, Artificial Sequence
  Description of Artificial Sequence: Synthetic polypeptide
EVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSS

SEQ ID NO: 7131 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDSVKGRFTISRDNSKNTLFLQMDSLRPEDTAVYYCARGGVYKGYFDEWGQGTLVTVSS

SEQ ID NO: 7132 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDTVKGRFTISRDNSKNTLFLQMDSLRAEDTAVYYCARGGVYKGYFDEWGQGTLVTVSS

SEQ ID NO: 7133 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDSVKGRFTISRDNSKNTLFLQMDSLRPEDTAVYYCARGGVYKGYFDEWGQGTLVTVSS

SEQ ID NO: 7134 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDSVKGRFTISRDNSKNTLFLQMDSLRAEDTAVYYCARGGVYKGYFDEWGQGTPVTVSS

SEQ ID NO: 7135 - protein, 119 aa, Artificial Sequence
  Description of Artificial Sequence: Synthetic polypeptide
EVQLVESGGGVVQPGRGLRLSCSASGFIFSRYDMSWVRQAPGKGLEWVAYISHGGAGTYYPDTVKGRFTISRDNSRNTLFLQMDSLRAEDTAVYYCARGGVYKGYFDYWGQGTPVTVSS

SEQ ID NO: 7136 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYVSHGGAGTYYPDTVKGRFTISRDNSKNTLFLQMDSLRAEDTAVYYCARGGVYKGYFDYWGQGTPVTVSS

SEQ ID NO: 7137 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRAEDTAVYYCARGGVYKGYFDYWGQGTPVTVSS

SEQ ID NO: 7138 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDTVKGRFTISRDNSKNTLFLQMDSLRAEDTAVYYCARGGVYKGYFDEWGQGTPVTVSS

SEQ ID NO: 7139 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRAEDTAVYYCARGGVYKGYFDVWGQGTPVTVSS

SEQ ID NO: 7140 - protein, 119 aa, Artificial Sequence
  Description of Artificial Sequence: Synthetic polypeptide
EVQLVESGGGVVQPGRSLRLGCSASGFIFSRYDMSWVRQAPGKGLEWVAYISHGGAGTYYPDTVKGRFTISRDNSKNTLFLQMDSLRAEDTAVYYCARGGVYKGYFDVWGQGTPVTVSS

SEQ ID NO: 7141 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDTVKGRFTISRDNSKNTLFLQMDSLRAEDTGVYYCARGGVYKGYFDVWGQGTPVTVSS

SEQ ID NO: 7142 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDTVKGRFTISRDNSKNTLFLQMNSLRAEDTGVYYCARGGVYKGYFDVWGQGTPVTVSS

SEQ ID NO: 7143 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRAEDTGVYYCARGGVYKGYFDVWGQGTPVTVSS

SEQ ID NO: 7144 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTAKGRFTISRDNSKNTLFLQMDSLRAEDTGVYYCARGGVYKGYFDVWGQGTPVTVSS

SEQ ID NO: 7145 - protein, 119 aa, Artificial Sequence
  Description of Artificial Sequence: Synthetic polypeptide
EVQLVESGGDVVQPGRSLRLSCSASGFIFSKYGMSWVRQAPGKGLEWVAYISHGGAGTYYPDTVKGRFTISRDNSKNTLFLQMDSLRAEDTGVYYCARGGVYKGYFDVWGQGTPVTVSS

SEQ ID NO: 7146 - protein, 119 aa, Artificial Sequence
  Description of Artificial Sequence: Synthetic polypeptide
EVQLVESGGDVVQPGRSLRLSCSAGGFIFSKYDMSWVRQAPGKGLEWVAYISHGGAGTYYPDTVKGRFTISRDNSKNTLFLQMDSLRAEDTGVYYCARGGVYKGYFDVWGQGTPVTVSS

SEQ ID NO: 7147 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRAEDTGVYYCARGGVYKGYFDVWGQGTPVTVSS

SEQ ID NO: 7148 - protein, 119 aa, Artificial Sequence
  Description of Artificial Sequence: Synthetic polypeptide
EVQLVESGGDVVQPGRSLRLSCSASGFIFSKYDMGWVRQAPGKGLEWVAYISHGGAGTYYPDTVKGRFTISRDNSKNTLFLQMDSLRAEDTGVYYCARGGVYKGYFDVWGQGTPVTVSS

SEQ ID NO: 7149 - protein, 119 aa, Artificial Sequence
  Description of Artificial Sequence: Synthetic polypeptide
EVQLVESGGDVVQPGRSLRLSCSASGFIFSKYDMSWVHQAPGKGLEWVAYISHGGAGTYYPDTVKGRFTISRDNSKNTLFLQMDSLRAEDTAVYYCARGGVYKGYFDVWGQGTPVTVSS

SEQ ID NO: 7150 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRPEDTAVYYCARGGVYKGYFDVWGQGTPVTVSS

SEQ ID NO: 7151 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRPEDTGVYYCARGGVYKGYFDVWGQGTPVTVSS

SEQ ID NO: 7152 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRPEDTGVYFCARGGVYKGYFDQWGQGTPVTVSS

SEQ ID NO: 7153 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRPEDTAVYFCARGGVYKGYFDVWGQGTPVTVSS

SEQ ID NO: 7154 - protein, 119 aa, Artificial Sequence
  Description of Artificial Sequence: Synthetic polypeptide
EVQLVESGGGVVQPGRSLRLSCSSSGFIFSSYDMSWVRQAPGKGLEWVAYISSGGGGTYYPDTVKGRFTISRDNSKNTLFLQMDSLRPEDTGVYFCARGGVTKGYFDVWGQGTPVTVSS

SEQ ID NO: 7155 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDTVKGRFTISRDNSKNTLFLQMDSLRPEDTAVYYCARGGVYKGYFDVWGQGTPVTVSS

SEQ ID NO: 7156 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDTVKGRFTISRDNSKNTLFLQMDSLRPEDTAVYYCARGGVYKGYFDVWGQGTPVTVSL

SEQ ID NO: 7157 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDSVKGRFTISRDNSKNTLFLQMDSLRAEDTAVYYCVRGGVYKGYFDVWGQGTPVTVSS

SEQ ID NO: 7158 - protein, 119 aa, Artificial Sequence; identical to SEQ ID NO: 6653
  Description of Artificial Sequence: Synthetic polypeptide

SEQ ID NO: 7159 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSPRAEDTGVYYCARGGVYKGYFDVWGQGTPVTVSS

SEQ ID NO: 7160 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTGVYYCARGGVYKGYFDVWGQGTPVTVSS

SEQ ID NO: 7161 - protein, 119 aa, Artificial Sequence; identical to SEQ ID NO: 6649
  Description of Artificial Sequence: Synthetic polypeptide

SEQ ID NO: 7162 - protein, 119 aa, Artificial Sequence
  Description of Artificial Sequence: Synthetic polypeptide
EVQLVESGGGVVQPGRSLRLSCSASGFIFSRYDMSRVRLAPGKGLEWVAYISHGGAGTYHPDSVKGRFTISRDNSKNTLFLQMDSLRPEDTAVYYCARGGVYKGYFDVWGQGTPVTVSS

SEQ ID NO: 7163 - protein, 119 aa, Artificial Sequence; identical to SEQ ID NO: 7133
  Description of Artificial Sequence: Synthetic polypeptide

SEQ ID NO: 7164 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYIGHGGAGTYYPDTVKGRFTISRNNSKNTLFLQMDSLRPEDTAVYYCARGGVYKGYFDEWGQGTLVTVSS

SEQ ID NO: 7165 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTAVYYCARGGVYKGYFDEWGQGTLVTVSS

SEQ ID NO: 7166 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTAVYYCARGGVYKGYFDLWGQGTPVTVSS

SEQ ID NO: 7167 - protein, 119 aa, Artificial Sequence
  Description of Artificial Sequence: Synthetic polypeptide
EVQLVESGGGVVQPGRSLRLSCASSGFIFSRYDMSWVRQAPGKGLEWVAYISHGGAGTYYPDSVKGRFTISRDNSKNTLFLQMDSLRAEDTGVYYCARGGVYKGYFDVWGQGTPVTVSS

SEQ ID NO: 7168 - protein, 119 aa, Artificial Sequence
  Description of Artificial Sequence: Synthetic polypeptide
EVQLVESGGGVVQPGRSLRLSCASSGFIFSRYDMSWVRQAPGKGLEWVAYISHGGAGTYYPDSVKGRFTISRDNSKNTLFLQMDSLRPEDTGVYYCARGGVYKGYFDVWGQGTPVTVSS

SEQ ID NO: 7169 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTGVYYCARGGVYKGYFDVWGQGTPVTVSS

SEQ ID NO: 7170 - protein, 119 aa, Artificial Sequence
  Description of Artificial Sequence: Synthetic polypeptide
EVQLVESGGGVVQPGRSLRLSCSSSGFIFSRYDMSWVRQAPGKGPEWVAYISHGGAGTYYPDSVKGRFTISRDNSKNTLFLQMDSLRPEDTGVYYCARGGVYKGYFDEWGQGTPVTVSS

SEQ ID NO: 7171 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTAVYYCARGGVYKGCFDVWGQGTPVTVSS

SEQ ID NO: 7172 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTAVYYCARGGVYKGYFDVWGQGTPVTVSS

SEQ ID NO: 7173 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTGVYFCARGGVYKGYFDEWGQGTPVTVSS

SEQ ID NO: 7174 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRPEDTGVYFCARGGVYKGYFDEWGQGTPVTVSS

SEQ ID NO: 7175 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVYKGYFDVWGQGTPVTVSS

SEQ ID NO: 7176 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRPEDTGVYYCARGGVYKGYFDVWGQGTPVTVSS

SEQ ID NO: 7177 - protein, 119 aa, Artificial Sequence; identical to SEQ ID NO: 6654
  Description of Artificial Sequence: Synthetic polypeptide

SEQ ID NO: 7178 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYYCARGGVYKGYFDVWGQGTLVTVSS

SEQ ID NO: 7179 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYYCARGGVYKGYFDVWGQGTPVTVSS

SEQ ID NO: 7180 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDSVKGRFTISRDNSKNTLFLQMDSLRPEDTAVYYCARGGVYKGYFDEWGQGTPVTVSS

SEQ ID NO: 7181 - protein, 119 aa, Artificial Sequence; identical to SEQ ID NO: 6647
  Description of Artificial Sequence: Synthetic polypeptide

SEQ ID NO: 7182 - protein, 119 aa, Artificial Sequence; identical to SEQ ID NO: 6649
  Description of Artificial Sequence: Synthetic polypeptide

SEQ ID NO: 7183 - protein, 119 aa, Artificial Sequence; identical to SEQ ID NO: 6653
  Description of Artificial Sequence: Synthetic polypeptide

SEQ ID NO: 7184 - protein, 119 aa, Artificial Sequence; identical to SEQ ID NO: 6654
  Description of Artificial Sequence: Synthetic polypeptide

SEQ ID NO: 7185 - protein, 119 aa, Artificial Sequence; identical to SEQ ID NO: 6648
  Description of Artificial Sequence: Synthetic polypeptide

SEQ ID NO: 7186 - protein, 119 aa, Artificial Sequence; identical to SEQ ID NO: 6650
  Description of Artificial Sequence: Synthetic polypeptide

SEQ ID NO: 7187 - protein, 119 aa, Artificial Sequence; identical to SEQ ID NO: 6651
  Description of Artificial Sequence: Synthetic polypeptide

SEQ ID NO: 7188 - protein, 119 aa, Artificial Sequence; identical to SEQ ID NO: 7180
  Description of Artificial Sequence: Synthetic polypeptide

SEQ ID NO: 7189 - protein, 119 aa, Artificial Sequence
  Description of Artificial Sequence: Synthetic polypeptide
EVQLVESGGGVVQPGRSLRLSCSASGFIFSKYDMSWVRQAPGKGLEWVAYISHGGAGTYYPDSVKGRFTISRDNSKNTLFLQMDSLRAEDTAVYYCARGGVYKGYFDVWGQGTLVTVSS

SEQ ID NO: 7190 - protein, 119 aa, Artificial Sequence; identical to SEQ ID NO: 6647
  Description of Artificial Sequence: Synthetic polypeptide

SEQ ID NO: 7191 - protein, 119 aa, Artificial Sequence; identical to SEQ ID NO: 6654
  Description of Artificial Sequence: Synthetic polypeptide

SEQ ID NO: 7192 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRAEDTGVYYCARGGVYKGYFDEWGQGTPVTVSS

SEQ ID NO: 7193 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRPEDTGVYYCARGGVYKGYFDEWGQGTPVTVSS

SEQ ID NO: 7194 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDTVKGRFTISRDNSKNTLFLQMDSLRPEDTGVYYCARGGVYKGYFDVWGQGTPVTVSS

SEQ ID NO: 7195 - protein, 119 aa, Artificial Sequence; identical to SEQ ID NO: 7141
  Description of Artificial Sequence: Synthetic polypeptide

SEQ ID NO: 7196 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDTVKGRFTISRDNSKNTLFLQMDSLRAEDTAVYYCARGGVYKGYFDVWGQGTPVTVSS

SEQ ID NO: 7197 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRVEDTAVYYCARGGVYKGYFDVWGQGTPVTVSS

SEQ ID NO: 7198 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRPEDTAVYYCARGGVYKGYFDVWGQGTPVTVSS

SEQ ID NO: 7199 - protein, 118 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYYCARGGVYKGYFDLWGQGTPVTVS

SEQ ID NO: 7200 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRAEDTAVYFCARGGVYKGYFDLWGQGTPVTVSS

SEQ ID NO: 7201 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTAVYFCARGGVYKGYFDVWGQGTPVTVSS

SEQ ID NO: 7202 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTVSRDNSKNTLFLQMDSLRPEDTAVYYCARGGVYKGYFDEWGQGTPVTVSS

SEQ ID NO: 7203 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRAEDTAVYYCARGGVYKGYFDEWGQGTPVTVSS

SEQ ID NO: 7204 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRAEDTGVYYCARGGVYKGYFDEWGQGTPVTVSS

SEQ ID NO: 7205 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTGVYFCARGGVYKGYFDEWGQGTPVTVSS

SEQ ID NO: 7206 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDSVKGRFTISRDNSKNTLFLQMDSLRAEDTAVYFCARGGVYKGYFDEWGQGTPVTVSS

SEQ ID NO: 7207 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTAVYYCARGGVYKGYFDEWGQGTPVTVSS

SEQ ID NO: 7208 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDSVKGRFTISRDNSKNTLFLQMDSLRPEDTAVYYCARGGVYKGYFDMWGQGTPVTVSS

SEQ ID NO: 7209 - protein, 119 aa, Artificial Sequence; identical to SEQ ID NO: 7165
  Description of Artificial Sequence: Synthetic polypeptide

SEQ ID NO: 7210 - protein, 119 aa, Artificial Sequence
  Description of Artificial Sequence: Synthetic polypeptide
EVQLVESGGGVVQPGRSLRLSCASSGFIFSRYDMSWVRQAPGKGLEWVAYISHGGAGTYYPDSVKGRFTISRDNSKNTLFLQMDSLRPEDTAVYYCARGGVYKGYFDEWGQGTLVTVSS

SEQ ID NO: 7211 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDSVKGRFTISRDNSKNTLFLQMDSLRPEDTAVYYCARGGVYKGYFDEWGQGTLVTVSS

SEQ ID NO: 7212 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRPEDTAVYYCARGGVYKGYFDEWGQGTLVTVSS

SEQ ID NO: 7213 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDSVKGRFTISRDNSKNTLFLQMDSLRPEDTAVYYCVRGGVYKGYFDQWGQGTLVTVSS

SEQ ID NO: 7214 - protein, 119 aa, Artificial Sequence
  Description of Artificial Sequence: Synthetic polypeptide
EVQLVESGGGVVQPGRSLRLSCSASGFIFSRYDMSWVRQAPGKGLEWVAYISHGGAGTYYPDTVKGRFTISRDNSKNTLFLQMDSLRPEDTAVYYCVRGGVYKGYFDQWGQGTLVTVSS

SEQ ID NO: 7215 - protein, 119 aa, Artificial Sequence
  Description of Artificial Sequence: Synthetic polypeptide
EVQLVESGGGVVQPGRSLRLSCSSSGFIFSRYDMSWVRQAPGKGLEWVAYISHGGAGTYYPDTVKGRFTISRDNSKNTLFLQMDSLRPEDTAVYYCARGGVYKGYFDEWGQGTLVTVSS

SEQ ID NO: 7216 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDTVKGRFTISRDNSKNTLFLQMDSLRPEDTAVYYCARGGVYKGYFDEWGQGTLVTVGS

SEQ ID NO: 7217 - protein, 119 aa, Artificial Sequence
  Description of Artificial Sequence: Synthetic polypeptide
EVQLVESGGGVVQPGRSLRLSCSSSGFIFSKYDMSWVRQAPGKGLEWVAYISHGGAGTYYPDSVKGRFTISRDNSKNTLFLQMDSLRPEDTAVYYCARGGVYKGYFDEWGQGTLVTVSS

SEQ ID NO: 7218 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRPEDTGVYYCARGGVYKGYFDEWGQGTLVTVSS

SEQ ID NO: 7219 - protein, 119 aa, Artificial Sequence
  Description of Artificial Sequence: Synthetic polypeptide
EVQLVEGGGDVVQPGRSLRLSCSASGFIFSKYDMSWVRQAPGKGLEWVAYISHGGAGTYYPDTVKGRFTISRDNSKNTLFLQMDSLRPEDTAVYYCARGGVYKGYFDEWGQGTLVTVSS

SEQ ID NO: 7220 - protein, 119 aa, Artificial Sequence
  Description of Artificial Sequence: Synthetic polypeptide
EVQLVESGGDVVQPGRSLRLSCSASGFIFSKYDMSWVRQAPGKGLEWVAYISHGGAGTYYPDTVKGRFTISRDNSKNTLFLQMDSLRPEDTAVYYCARGGVYKGYFDEWGQGTLVTVSS

SEQ ID NO: 7221 - protein, 126 aa, Artificial Sequence
  Description of Artificial Sequence: Synthetic polypeptide
QVQLVESGGGVVQPGRSLRLSCAASGFIFSSYAMHWVRQAPGNGLEWVAFMSYDGSNKKYADSVKGRFTISRDNSKNTLYLQMNSLRAEDTAVYYCARDRGIAAGGNYYYYGMDVWGQGTTVTVSS

SEQ ID NO: 7222 - protein, 10 aa, Artificial Sequence
  Description of Artificial Sequence: Synthetic peptide
GRNIKDTYIH

SEQ ID NO: 7223 - protein, 17 aa, Artificial Sequence
  Description of Artificial Sequence: Synthetic peptide
RIYPTNGYTRYADSVKG

SEQ ID NO: 7224 - protein, 11 aa, Artificial Sequence
  Description of Artificial Sequence: Synthetic peptide
WGGDGFYAMDY

SEQ ID NO: 7225 - protein, 223 aa, Artificial Sequence
  Description of Artificial Sequence: Synthetic polypeptide
QVQLVQSGAEVKKPGASVKVSCKASGYTFTSHWMHWVRQAPGQGLEWIGEFNPSNGRTNYNEKFKSKATMTVDTSTNTAYMELSSLRSEDTAVYYCASRDYDYDGRYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 7226 - protein, 119 aa, Artificial Sequence
  Description of Artificial Sequence: Synthetic polypeptide
VQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSS

SEQ ID NO: 7227 - protein, 120 aa, Artificial Sequence
  Description of Artificial Sequence: Synthetic polypeptide
EVQLQESGPGLVKPSETLSLTCTVSGDSITNGFWIWIRKPPGNKLEYMGYISYSGSTYYNPSLKSRISISRDTSKNQFSLKLSSVTAADTGVYYCACRSYGRTPYYFDFWGQGTTLTVSS

SEQ ID NO: 7228 - protein, 120 aa, Artificial Sequence
  Description of Artificial Sequence: Synthetic polypeptide
EVQLQESGPGLVKPSQTLSLTCTVSGDSITNGFWIWIRKHPGNKLEYMGYISYSGSTYYNPSLKSRISISRDTSKNQFSLKLSSVTAADTGVYYCACRSYGRTPYYFDFWGQGTTLTVSS

SEQ ID NO: 7229 - protein, 120 aa, Artificial Sequence
  Description of Artificial Sequence: Synthetic polypeptide
EVQLQESGPGLVKPSQTLSLTCAVSGDSITNGFWIWIRKHPGNKLEYMGYISYSGSTYYNPSLKSRISISRDTSNNQFSLNLNSVTRADTGVYYCACRSYGRTPYYFDFWGQGTTLTVSS

SEQ ID NO: 7230 - protein, 120 aa, Artificial Sequence
  Description of Artificial Sequence: Synthetic polypeptide
EVQLQESGPGLVKPSETLSLTCAVYGDSITNGFWIWIRKPPGNKLEYMGYISYSGSTYYNPSLKSRISISRDTSKNQFYLKLSSVTAADTGVYYCACRSYGRTPYYFDFWGQGTTLTVSS

SEQ ID NO: 7231 - protein, 122 aa, Artificial Sequence
  Description of Artificial Sequence: Synthetic polypeptide
QVQLVQSGAEVKKPGASVKVSCKASGYTFSMYWLEWVRQAPGHGLEWVGEISPGTFTTNYNEKFKARATFTADTSTNTAYMELSSLRSEDTAVYYCARFSHFSGSNYDYFDYWGQGTLVTVS

SEQ ID NO: 7232 - protein, 118 aa, Artificial Sequence
  Description of Artificial Sequence: Synthetic polypeptide
QVQLVQSGAEVKKPGASVKVSCKASGYTFTEYYMYWVRQAPGQGLELMGRIDPEDGSIDYVEKFKKKVTLTADTSSSTAYMELSSLTSDDTAVYYCARGKFNYRFAYWGQGTLVTVSS

SEQ ID NO: 7233 - protein, 128 aa, Artificial Sequence
  Description of Artificial Sequence: Synthetic polypeptide
MAWALLLLGLLAHFTDSAASYELSQPRSVSVSPGQTAGFTCGGDNVGRKSVQWYQQKPPQAPVLVIYADSERPSGIPARFSGSNSGNTATLTISGVEAGDEADYYCQVWDSTADHWVFGGGTRLTVLG

SEQ ID NO: 7234 - protein, 121 aa, Artificial Sequence
  Description of Artificial Sequence: Synthetic polypeptide
QVQLVQSGAEVKKPGSSVKVSCKASGYTFTFYNMHWVRQAPGQGLEWIGAIYPGNGDTSYNQKFKGKATITADKSTSTAYMELSSLRSDDTAVYYCARSTYYAGDWNFNNWGQGTLVTVSS

SEQ ID NO: 7235 - protein, 121 aa, Artificial Sequence
  Description of Artificial Sequence: Synthetic polypeptide
QVQLVQSGAEVKKPGSSVKVSCKASGYTFTSYNMHWVRQAPGQGLEWIGAIYPGNGATSYNQKFKGKATITADKSTSTAYMELSSLRSDDTAVYYCARSTYYAGDWNFNNWGQGTLVTVSS

SEQ ID NO: 7236 - protein, 121 aa, Artificial Sequence
  Description of Artificial Sequence: Synthetic polypeptide
QVQLVQSGAEVKKPGSSVKVSCKASGYTFTSYNMHWVRQAPGQGLEWIGAIYPGNGLTSYNQKFKGKATITADKSTSTAYMELSSLRSDDTAVYYCARSTYYAGDWNFNNWGQGTLVTVSS

SEQ ID NO: 7237 - protein, 121 aa, Artificial Sequence
  Description of Artificial Sequence: Synthetic polypeptide
QVQLVQSGAEVKKPGSSVKVSCKASGYTFTSYNMHWVRQAPGQGLEWIGAIYPGNGDTSYNQKFKGKATITADKSTSTAYMELSSLRSDDTAVYYCARSTYYAGDWNFGNWGQGTLVTVSS

SEQ ID NO: 7238 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSHIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7239 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSFIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7240 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSLIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7241 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSMIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7242 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGLSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7243 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGSSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7244 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGTSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7245 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGWSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7246 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDVYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7247 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDHYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7248 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDSYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7249 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDQYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7250 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGGTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7251 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGMTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7252 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGNTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7253 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGHTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7254 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGLTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7255 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGFTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7256 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSGIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7257 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSIIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7258 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSDIGPSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7259 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDMYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7260 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDLYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7261 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDTYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7262 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGITKYADSVKGRFTISRDNSKNTLYLQMNSLRAEDTATYYCAREGHNDIYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7263 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGGSGGITKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7264 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGWTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7265 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGYTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7266 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGSTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7267 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGPTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7268 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGVTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7269 - protein, 230 aa, Artificial Sequence
  Description of Artificial Sequence: Synthetic polypeptide
EVQLLESGGGLVQPGGSLRLSCAASGFTFSIYPMFWVRQAPGKGLEWVSWIGPSGGTTKYADSVKGRFTISRDNSKNTLYLQMNSLRAEDTATYYCAREGHNDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 7270 - protein, 230 aa, Artificial Sequence; identical to SEQ ID NO: 7249
  Description of Artificial Sequence: Synthetic polypeptide

SEQ ID NO: 7271 - protein, 466 aa, Artificial Sequence
  Description of Artificial Sequence: Synthetic polypeptide
MDWTWRVFCLLAVAPGAHSQVQLVQSGAEVKKPGASVKVSCKASGYTFTDYSMDWVRQAPGQGLEWMGAINPNSGGTNYNQKFKDRVTMTRDTSTSTVYMELSSLRSEDTAVYYCARSGSYDGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 7272 - protein, 466 aa, Artificial Sequence
  Description of Artificial Sequence: Synthetic polypeptide
MDWTWRVFCLLAVAPGAHSQVQLVQSGAEVKKPGASVKVSCKASGYTFTDYSMDWVRQAPGQGLEWMGAINPNSGGTNYNQKFKDRVTMTRDTSTSTVYMELSSLRSEDTAVYYCARSGSYDGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7273 - protein, 465 aa, Artificial Sequence
  Description of Artificial Sequence: Synthetic polypeptide
MDWTWRVFCLLAVAPGAHSQVQLVQSGAEVKKPGASVKVSCKASGYTFTDYSMDWVRQAPGQGLEWMGAIHLNTGYTNYNQKFKGRVTMTRDTSTSTVYMELSSLRSEDTAVYYCARGFYDGYSPMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 7274 - protein, 465 aa, Artificial Sequence
  Description of Artificial Sequence: Synthetic polypeptide
MDWTWRVFCLLAVAPGAHSQVQLVQSGAEVKKPGASVKVSCKASGYTFTDYSMDWVRQAPGQGLEWMGAIHLNTGYTNYNQKFKGRVTMTRDTSTSTVYMELSSLRSEDTAVYYCARGFYDGYSPMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7275 - protein, 463 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSPNPYYYDSSGYYYPGAFDIWGQGTMVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 7276 - protein, 454 aa, Artificial Sequence
  Description of Artificial Sequence: Synthetic polypeptide
QVQLVQSGAEVKRPGASVKVSCKASGYTFTNDIIHWVRQAPGQRLEWMGWINAGYGNTQYSQNFQDRVSITRDTSASTAYMELISLRSEDTAVYYCAREPLWFGESSPHDYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7277 - protein, 451 aa, Artificial Sequence
  Description of Artificial Sequence: Synthetic polypeptide
EVQLLESGGGLVQPGGSLRLSCAASGFTFSNAWMSWVRQAPGKGLEWVSSISVGGHRTYYADSVKGRSTISRDNSKNTLYLQMNSLRAEDTAVYYCARIRVGPSGGAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7278 - protein, 453 aa, Artificial Sequence
  Description of Artificial Sequence: Synthetic polypeptide
QVQLVQSGAEVMKPGSSVKVSCKASGYTFSWYWLEWVRQAPGHGLEWMGEIDPGTFTTNYNEKFKARVTFTADTSTSTAYMELSSLRSEDTAVYYCARFSHFSGSNYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7279 - protein, 118 aa, Artificial Sequence
  Description of Artificial Sequence: Synthetic polypeptide
QVQLVQSGGGVVQPGRSLRLSCAASGFTFSSYGMHWVRQAPGKGLEWVAVISYDGSIKHYADSVKGRFTISRDNSKNTLYLQMNSLRTDDTAVYYCAGDTDYGDIDPWGQGTMVTVSS

SEQ ID NO: 7280 - protein, 565 aa, Artificial Sequence
  Description of Artificial Sequence: Synthetic polypeptide
EVKLEESGGGLVQPGGSMKLSCVASGFTFSNYMNWVRQSPEKGLEVAEIRLKSNNYATHYAESVKGRFTISRDDSKSSVYLQMNNLRAEDTGIYYCTDYDAYWGQGTLVTVSAESQSFPNVFPLVSCESPLSDKNLVAMGCLARDFLPSTISFTWNYQNNTEVIQGIRTFPTLRTGGKYLATSQVLLSPKSILEGSDEYLVCKIHYGGKNRDLHVPIPAVAEMNPNVNVFVPPRDGFSGPAPRKSKLICEATNFTPKPITVSWLKDGKLVESGFTTDPVTIENKGSTPQTYKVISTLTISEIDWLNLNVYTCRVDHRGLTFLKNVSSTCAASPSTDILTFTIPPSFADIFLSKSANLTCLVSNLATYETLNISWASQSGEPLETKIKIMESHPNGTFSAKGVASVCVEDWNNRKEFVCTVHRDLPSPQKKFISKPNEVHKHPPAVYLLPPAREQLNLRESATVTCLVKGFSPADISVQLQRGQLLPQEKYVTSAPMPEPGAPGFYFTHSILTVTEEEWNSGETYTCWGHEALPHLVTERTVDKSTGKPTLYNVSLIMSDTGGTCY

SEQ ID NO: 7281 - protein, 449 aa, Artificial Sequence
  Description of Artificial Sequence: Synthetic polypeptide
QVQLVQSGAEVKKPGASVKVSCKASGYSFTNYYIHWVRQAPGQRLEWMGWINAGNGNTKYSQKFQGRVTITRDTSASTAYMELSSLRSEDTAVYYCVRRQRFPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7282 - protein, 449 aa, Artificial Sequence
  Description of Artificial Sequence: Synthetic polypeptide
QVQLVQSGAEVKKPGSSVKVSCKASGYTFTDQTIHWMRQAPGQGLEWIGYIYPRDDSPKYNENFKGKVTITADKSTSTAYMELSSLRSEDTAVYYCAIPDRSGYAWFIYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7283 - protein, 229 aa, Artificial Sequence; identical to SEQ ID NO: 6956
  Description of Artificial Sequence: Synthetic polypeptide

SEQ ID NO: 7284 - protein, 448 aa, Artificial Sequence
  Description of Artificial Sequence: Synthetic polypeptide
QVQLVESGGGVVQPGRSLRLSCAASGFKFSGYGMHWVRQAPGKGLEWVAVIWYDGSKKYYVDSVKGRFTISRDNSKNTLYLQMNSLRAEDTAVYYCARQMGYWHFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7285 - protein, 449 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7286 - protein, 468 aa, Artificial Sequence
  Description of Artificial Sequence: Synthetic polypeptide
MGWSCIILFLVATATGVHSEVQLLESGGGLVQPGGSLRLSCAASGFTFSSFPMAWVRQAPGKGLEWVSTISTSGGRTYYRDSVKGRFTISRDNSKNTLYLQMNSLRAEDTAVYYCAKFRQYSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7287 - protein, 471 aa, Artificial Sequence
  Description of Artificial Sequence: Synthetic polypeptide
MEFGLSWVFLVALLRGVQCQVQLVESGGGVVQPGRSLRLSCTASGFTFSMFGVHWVRQAPGKGLEWVAAVSYDGSNKYYAESVKGRFTISRDNSKNILFLQMDSLRLEDTAVYYCARGRPKVVIPAPLAHWGQGTLVTFSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7288 - protein, 449 aa, Artificial Sequence
  Description of Artificial Sequence: Synthetic polypeptide
EGQLVQSGGGLVHPGGSLRLSCAGSGFTFSSYGMHWVRQAPGKGLEWVSGIGTGGGTYSTDSVKGRFTISRDNAKNSLYLQMNSLRAEDMAVYYCARGDYYGSGSFFDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7289 - protein, 447 aa, Artificial Sequence
  Description of Artificial Sequence: Synthetic polypeptide
QVQLVQSGAEVKKPGSSVKVSCKASGYTFSSNVISWVRQAPGQGLEWMGGVIPIVDIANYAQRFKGRVTITADESTSTTYMELSSLRSEDTAVYYCASTLGLVLDAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7290 - protein, 449 aa, Artificial Sequence
  Description of Artificial Sequence: Synthetic polypeptide
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 7291 - protein, 444 aa, Artificial Sequence
  Description of Artificial Sequence: Synthetic polypeptide
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 7292 - protein, 467 aa, Artificial Sequence
  Description of Artificial Sequence: Synthetic polypeptide
MEFGLSWLFLVAILKGVQCEVQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 7293 - protein, 452 aa, Artificial Sequence
  Description of Artificial Sequence: Synthetic polypeptide
EVQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7294 - protein, 122 aa, Artificial Sequence
  Description of Artificial Sequence: Synthetic polypeptide
QVQLQQSGAELMKPGASVKMSCKATGYIFSNYWIQWIKQRPGHGLEWIGEILPGSGSTEYTENFKDKAAFTADTSSNTAYMQLSSLTSEDSAVYYCARYFFGSSPNWYFDVWGAGTTVTVSS

SEQ ID NO: 7295 - protein, 447 aa, Artificial Sequence
  Description of Artificial Sequence: Synthetic polypeptide
EVQLVQSGAEVKKPGESLKISCKGSGYSFSNYWIGWVRQMPGKGLEWMGIIDPSNSYTRYSPSFQGQVTISADKSISTAYLQWSSLKASDTAMYYCARWYYKPFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7296 - protein, 450 aa, Artificial Sequence; identical to SEQ ID NO: 5271
  Description of Artificial Sequence: Synthetic polypeptide

SEQ ID NO: 7297 - protein, 449 aa, Artificial Sequence
  Description of Artificial Sequence: Synthetic polypeptide
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7298 - protein, 118 aa, Artificial Sequence
  Description of Artificial Sequence: Synthetic polypeptide
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVS

SEQ ID NO: 7299 - protein, 119 aa, Artificial Sequence
  Description of Artificial Sequence: Synthetic polypeptide
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVSS

SEQ ID NO: 7300 - protein, 448 aa, Artificial Sequence
  Description of Artificial Sequence: Synthetic polypeptide
QLQLQESGPGLLKPSETLSLTCTVSGGSISSPGYYGGWIRQPPGKGLEWIGSIYKSGSTYHNPSLKSRVTISVDTSKNQFSLKLSSVTAADTAVYYCTRPVVRYFGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7301 - protein, 454 aa, Artificial Sequence
  Description of Artificial Sequence: Synthetic polypeptide
EEQLVESGGGLVKPGGSLRLSCAASGFSFSDCRMYWLRQAPGKGLEWIGVISVKSENYGANYAESVRGRFTISRDDSKNTVYLQMNSLKTEDTAVYYCSASYYRYDVGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7302 - protein, 341 aa, Artificial Sequence
  Description of Artificial Sequence: Synthetic polypeptide
DIQMTQSPSSLSASVGDRVTITCRASQAIDSYLHWYQQKPGKAPKLLIYSASNLETGVPSRFSGSGSGTDFTLTISSLLPEDFATYYCQQVVWRPFTFGQGTKVEIKRVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7303 - protein, 445 aa, Artificial Sequence; identical to SEQ ID NO: 5027
  Description of Artificial Sequence: Synthetic polypeptide

SEQ ID NO: 7304 - protein, 455 aa, Artificial Sequence
  Description of Artificial Sequence: Synthetic polypeptide
EVQLVESGGGLVQPGGSLRLSCAASGFTFSDYNMAWVRQAPGKGLEWVATITYEGRNTYYRDSVKGRFTISRDNAKNSLYLQMNSLRAEDTAVYYCASPPQYYEGSIYRLWFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7305 - protein, 463 aa, Artificial Sequence
  Description of Artificial Sequence: Synthetic polypeptide
MDWTWRVFCLLAVAPGAHSQVQLVQSGAEVVKPGASVKLSCKASGYIFTSYYMYWVKQAPGQGLEWIGEINPSNGDTNFNEKFKSKATLTVDKSASTAYMELSSLRSEDTAVYYCTRSDGRNDMDSWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSAYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 7306 - protein, 447 aa, Artificial Sequence
  Description of Artificial Sequence: Synthetic polypeptide
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7307 - protein, 454 aa, Artificial Sequence
  Description of Artificial Sequence: Synthetic polypeptide
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7308 - protein, 450 aa, Artificial Sequence; identical to SEQ ID NO: 5110
  Description of Artificial Sequence: Synthetic polypeptide

SEQ ID NO: 7309 - protein, 449 aa, Artificial Sequence
  Description of Artificial Sequence: Synthetic polypeptide
EVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7310 - protein, 447 aa, Artificial Sequence
  Description of Artificial Sequence: Synthetic polypeptide
EVQLVESGGGLVQPGGSLRLSCAASGYTFTSYVIHWVRQAPGKGLEWVGYNNPYNAGTNYNEKFKGRFTISSDKSKNTAYLQMNSLRAEDTAVYYCSRPTMLPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7311 - protein, 449 aa, Artificial Sequence
  Description of Artificial Sequence: Synthetic polypeptide
QVQLVQSGAEVKKPGASVKVSCKAFGYPFTDYLLHWVRQAPGQGLEWVGWLNPYSGDTNYAQKFQGRVTMTRDTSISTAYMELSRLRSDDTAVYYCTRTTLISVYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7312 - protein, 224 aa, Artificial Sequence
  Description of Artificial Sequence: Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7313 - protein, 229 aa, Artificial Sequence
  Description of Artificial Sequence: Synthetic polypeptide
EVQLVESGGGLVQPGGSLRLSCAVSGFSSTNYHVHWVRQAPGKGLEWMGVIWGDGDTSYNSVLKSRFTISRDTSKNTVYLQMNSLRAEDTAVYYCARQLTHYYVLAAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 7314 - protein, 221 aa, Artificial Sequence
  Description of Artificial Sequence: Synthetic polypeptide
EVQLVESGGGLVQPGGSLRLSCAVSGFSSTNYHVHWVRQAPGKGLEWMGVIWGDGDTSYNSVLKSRFTISRDTSKNTVYLQMNSLRAEDTAVYYCARQLTHYYVLAAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7315 - protein, 447 aa, Artificial Sequence
  Description of Artificial Sequence: Synthetic polypeptide
EVQLVQSGAEVKKPGESLKISCKGSGYIFTNYWIAWVRQMPGKGLESMGIIYPGDSDIRYSPSFQGQVTISADKSITTAYLQWSSLKASDTAMYYCARHDIEGFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7316 - protein, 447 aa, Artificial Sequence
  Description of Artificial Sequence: Synthetic polypeptide
EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7317 - protein, 470 aa, Artificial Sequence
  Description of Artificial Sequence: Synthetic polypeptide
MGWSCIILFLVATATGVHSQVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7318 - protein, 452 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7319 - protein, 116 aa, Artificial Sequence
  Description of Artificial Sequence: Synthetic polypeptide
QVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSS

SEQ ID NO: 7320 - protein, 456 aa, Artificial Sequence
  Description of Artificial Sequence: Synthetic polypeptide
QVQLQQSGAELVKPGASVKLSCKASGYTFRSYDINWVRQRPEQGLEWIGWIFPGDGSTKYNEKFKGKATLTTDKSSSTAYMQLSRLTSEDSAVYFCARWTVVGPGYFDVWGAGTTVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 7321 - protein, 443 aa, Artificial Sequence
  Description of Artificial Sequence: Synthetic polypeptide
QVKLQESGAELARPGASVKLSCKASGYTFTNYWMQWVKQRPGQGLDWIGAIYPGDGNTRYTHKFKGKATLTADKSSSTAYMQLSSLASEDSGVYYCARGEGNYAWFAYWGQGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 7322 - protein, 453 aa, Artificial Sequence
  Description of Artificial Sequence: Synthetic polypeptide
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7323 - protein, 326 aa, Artificial Sequence; identical to SEQ ID NO: 5352
  Description of Artificial Sequence: Synthetic polypeptide

SEQ ID NO: 7324 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7325 - protein, 224 aa, Artificial Sequence
  Description of Artificial Sequence: Synthetic polypeptide
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESRVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7326 - protein, 96 aa, Artificial Sequence
  Description of Artificial Sequence: Synthetic polypeptide
EVQLVESGGDFVQPGGSLRVSCAASGFAFSHYAMSWVRQAPGKGLEWVAYISSGGSGTYYSDSVKGRFTISRDNSKNTLYLQMRSLRAEDSAVYFC

SEQ ID NO: 7327 - protein, 116 aa, Artificial Sequence
  Description of Artificial Sequence: Synthetic polypeptide
QVQLQESGPGLVKPSETLSLTCTVSGFSLTNYGVHWVRQSPGKGLEWIGVKWSGGSTEYNAAFISRLTISKDTSKNQVSLKLNSLTAADTAVYYCARNDRYAMDYWGQGTLVTVSS

SEQ ID NO: 7328 - protein, 446 aa, Artificial Sequence
  Description of Artificial Sequence: Synthetic polypeptide
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7329 - protein, 8 aa, Artificial Sequence
  Description of Artificial Sequence: Synthetic peptide
GFAFSIYD

SEQ ID NO: 7330 - protein, 5 aa, Artificial Sequence
  Description of Artificial Sequence: Synthetic peptide
NYWIH

SEQ ID NO: 7331 - protein, 7 aa, Artificial Sequence
  Description of Artificial Sequence: Synthetic peptide
SGDYYWS

SEQ ID NO: 7332 - protein, 5 aa, Artificial Sequence
  Description of Artificial Sequence: Synthetic peptide
IYYWS

SEQ ID NO: 7333 - protein, 10 aa, Artificial Sequence
  Description of Artificial Sequence: Synthetic peptide
GYTFTSYWLH

SEQ ID NO: 7334 - protein, 5 aa, Artificial Sequence
  Description of Artificial Sequence: Synthetic peptide
NYYMY

SEQ ID NO: 7335 - protein, 8 aa, Artificial Sequence
  Description of Artificial Sequence: Synthetic peptide
ISSGGGTT

SEQ ID NO: 7336 - protein, 17 aa, Artificial Sequence
  Description of Artificial Sequence: Synthetic peptide
GINPGNNYATYRRKFQG

SEQ ID NO: 7337 - protein, 16 aa, Artificial Sequence
  Description of Artificial Sequence: Synthetic peptide
YIYYSGSTDYNPSLKS

SEQ ID NO: 7338 - protein, 16 aa, Artificial Sequence
  Description of Artificial Sequence: Synthetic peptide
YVYYSGSTNYNPSLKS

SEQ ID NO: 7339 - protein, 18 aa, Artificial Sequence
  Description of Artificial Sequence: Synthetic peptide
GMIDPSNSDTRFNPNFKD

SEQ ID NO: 7340 - protein, 17 aa, Artificial Sequence
  Description of Artificial Sequence: Synthetic peptide
GINPSNGGTNFNEKFKN

SEQ ID NO: 7341 - protein, 16 aa, Artificial Sequence
  Description of Artificial Sequence: Synthetic peptide
ARHSGYGTHWGVLFAY

SEQ ID NO: 7342 - protein, 12 aa, Artificial Sequence
  Description of Artificial Sequence: Synthetic peptide
EGYGNYGAWFAY

SEQ ID NO: 7343 - protein, 11 aa, Artificial Sequence
  Description of Artificial Sequence: Synthetic peptide
VSIFGVGTFDY

SEQ ID NO: 7344 - protein, 12 aa, Artificial Sequence
  Description of Artificial Sequence: Synthetic peptide
GGYDFWSGYFDY

SEQ ID NO: 7345 - protein, 12 aa, Artificial Sequence
  Description of Artificial Sequence: Synthetic peptide
ATYRSYVTPLDY

SEQ ID NO: 7346 - protein, 11 aa, Artificial Sequence
  Description of Artificial Sequence: Synthetic peptide
RDYRFDMGFDY

SEQ ID NO: 7347 - protein, 220 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 7348 - protein, 448 aa, Artificial Sequence
  Description of Artificial Sequence: Synthetic polypeptide
QVQLVESGGGVVQPGRSLRLSCAASGFTFSVYGMNWVRQAPGKGLEWVAIIWYDGDNQYYADSVKGRFTISRDNSKNTLYLQMNGLRAEDTAVYYCARDLRTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7349 - protein, 450 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7350 - protein, 437 aa, Artificial Sequence
  Description of Artificial Sequence: Synthetic polypeptide
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7351 - protein, 247 aa, Artificial Sequence
  Description of Artificial Sequence: Synthetic polypeptide
QVQLVQSGAEVKKPGASVKVSCKASGYTFSAYWIEWVRQAPGKGLEWVGEILPGSNNSRYNEKFKGRVTVTADTSTNTAYMELSSLRSEDTAVYYCARSYDFAWFAYWGQGTLVTVSSGGGGSGGGGSGGGGSDIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIKR

SEQ ID NO: 7352 - protein, 5 aa, Artificial Sequence
  Description of Artificial Sequence: Synthetic peptide
RYWMS

SEQ ID NO: 7353 - protein, 17 aa, Artificial Sequence
  Description of Artificial Sequence: Synthetic peptide
EINPDSSTINYAPSLKD

SEQ ID NO: 7354 - protein, 10 aa, Artificial Sequence
  Description of Artificial Sequence: Synthetic peptide
PDGNYWYFDV

SEQ ID NO: 7355 - protein, 11 aa, Artificial Sequence
  Description of Artificial Sequence: Synthetic peptide
KASQDVGIAVA

SEQ ID NO: 7356 - protein, 7 aa, Artificial Sequence
  Description of Artificial Sequence: Synthetic peptide
WASTRHT

SEQ ID NO: 7357 - protein, 9 aa, Artificial Sequence
  Description of Artificial Sequence: Synthetic peptide
QQYSSYPYT

SEQ ID NO: 7358 - protein, 220 aa, Artificial Sequence
  Description of Artificial Sequence: Synthetic polypeptide
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVE

SEQ ID NO: 7359 - protein, 219 aa, Artificial Sequence
  Description of Artificial Sequence: Synthetic polypeptide
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 7360 - protein, 211 aa, Artificial Sequence
  Description of Artificial Sequence: Synthetic polypeptide
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 7361 - protein, 214 aa, Artificial Sequence
  Description of Artificial Sequence: Synthetic polypeptide
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7362 - protein, 214 aa, Artificial Sequence
  Description of Artificial Sequence: Synthetic polypeptide
QVDIQMTQSPSSLSASVGDRVTITCSASSSVTYMYWYQQKPGKAPKLLIYDTSNLASGVPSRFSGSGSGTDYTFTISSLQPEDIATYYCQQWSSHIFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 7363 - protein, 447 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7364 - protein, 210 aa, Artificial Sequence
  Description of Artificial Sequence: Synthetic polypeptide
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 7365 - protein, 330 aa, Artificial Sequence [sequence omitted]

SEQ ID NO: 7366 - protein, 218 aa, Artificial Sequence
  Description of Artificial Sequence: Synthetic polypeptide
DIQMTQSPSSLSASVGDRVTITCKASQSVDYDGDSYMNWYQQKPGKAPKLLIYAASNLESGIPSRFSGSGSGTDFTLTISSLQPEDFATYYCQQSNEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7367 - protein, 218 aa, Artificial Sequence; identical to SEQ ID NO: 7366
  Description of Artificial Sequence: Synthetic polypeptide

SEQ ID NO: 7368 - protein, 443 aa, Artificial Sequence
  Description of Artificial Sequence: Synthetic polypeptide
EVQLVESGGGLVQPGGSLRLSCAASGFTFSTYAMSWVRQAPGKGLEWVASISTGGSTYYPDSVKGRFTISRDNAKNTLYLQMNSLRAEDTAVYYCARDYDGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVGWESNGQPENNYKTTPPVLDSDGSFFLYSRLTVDKSRWQEGNVFSCSVMHEALHNHYTQKSLSLSLGK

SEQ ID NO: 7369 - protein, 443 aa, Artificial Sequence
  Description of Artificial Sequence: Synthetic polypeptide
EVQLVESGGGLVQPGGSLRLSCAASGFTFSTYAMSWVRQAPGKGLEWVASISTGGSTYYPDSVKGRFTISRDNAKNTLYLQMNSLRAEDTAVYYCARDYDGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 7370 - protein, 105 aa, Artificial Sequence
  Description of Artificial Sequence: Synthetic polypeptide
DAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7371 - protein, 106 aa, Artificial Sequence
  Description of Artificial Sequence: Synthetic polypeptide
EIVLTQSPSSLSASVGDRVTITCSARSSVSYMHWYQQKPGKAPKLLIYRTSNLASGVPSRFSGSGSGTDFTLTINSLQPEDFATYYCQQRSSFPLTFGGGTKLEIK

SEQ ID NO: 7372 - protein, 106 aa, Artificial Sequence
  Description of Artificial Sequence: Synthetic polypeptide
EIVLTQSPSSLSASVGDRVTITCSARSSVSYMHWFQQKPGKAPKLWIYRTSNLASGVPSRFSGSGSGTDYTLTINSLQPEDFATYYCQQRSSFPLTFGGGTKLEIK

SEQ ID NO: 7373 - protein, 106 aa, Artificial Sequence
  Description of Artificial Sequence: Synthetic polypeptide
EIVLTQSPSSLSASVGDRVTITCSARSSVSYMHWFQQKPGKAPKLWIYRTSNLASGVPSRFSGSGSGTDYCLTINSLQPEDFATYYCQQRSSFPLTFGGGTKLEIK

SEQ ID NO: 7374 - protein, 106 aa, Artificial Sequence
  Description of Artificial Sequence: Synthetic polypeptide
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 7375 - protein, 113 aa, Artificial Sequence
  Description of Artificial Sequence: Synthetic polypeptide
DIVMTQSPSSLTVTAGEKVTMSCKSSQSLLDSGNQKNFLTWYQQKPGQPPKLLIFWASTRESGVPDRFTGSGSVTDFTLTISSVQAEDLAVYYCQNDYSYPCTFGGGTKLEIK

SEQ ID NO: 7376 - protein, 107 aa, Artificial Sequence
  Description of Artificial Sequence: Synthetic polypeptide
DIVMTQTPSSLSASVGDRVTITCRASQDISKFLNWYQQKPGKAIKLLIYHTSRLHSGVPSRFSGSGSGTDFTLTISSLQPEDFATYYCQQGNTLPYTFGPGTKVDIK

SEQ ID NO: 7377 - protein, 107 aa, Artificial Sequence
  Description of Artificial Sequence: Synthetic polypeptide
DIQMTQSPSSLSASVGDRVTITCRASQDISKYLNWYQQKPGKAPKLLIYHTSRLHSGVPSRFSGSGSGTDFTLTISSLQPEDFATYYCQQGATLPYTFGPGTKVDIK

SEQ ID NO: 7378 - protein, 107 aa, Artificial Sequence
  Description of Artificial Sequence: Synthetic polypeptide
DIQMTQSPSSLSASVGDRVTITCRASQDISKFLNWYQQKPGKAPKLLIYHTSRLHSGVPSRFSGSGSGTDFTLTISSLQPEDFATYYCQQGATLPYTFGPGTKVDIK

SEQ ID NO: 7379 - protein, 107 aa, Artificial Sequence
  Description of Artificial Sequence: Synthetic polypeptide
DIQMTQSPSSLSASVGDRVTITCRASQDISKYLNWYQQKPGKAIKLLIYHTSRLHSGVPSRFSGSGSGTDFTLTISSLQPEDFATYYCQQGATLPYTFGPGTKVDIK

SEQ ID NO: 7380 - protein, 240 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISKDNSKNTLYLQMNSLRAEDTAVYYCARHYYYGGSYAMDYWGQGTLVTVSSQVQLVQSGGGVVQPGRSLRLSCAASGVSLPDYGVSWVRQAPGKGLEWVAVIWGSETTYYNSALKSRFTISRDNSKNTVYLQMNSLRAEDTAVYYCARHYYYGGSYAMDYWGQGTLVTVSS

SEQ ID NO: 7381 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSS

SEQ ID NO: 7382 - protein, 107 aa, Artificial Sequence
  Description of Artificial Sequence: Synthetic polypeptide
DIVMTQTPSSLSASVGDRVTITCRASQDISKYLNWYQQKPGKAVKLLIYHTSRLHSGVPSRFSGSGSGTDFTLTISSLQPEDFATYYCQQGNTLPYTFGPGTKVDIK

SEQ ID NO: 7383 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDYTLTISSLQPEDFATYYCQQGNTLPYTFGPGTKVDIK

SEQ ID NO: 7384 - protein, 214 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7385 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7386 - protein, 253 aa, Artificial Sequence
  Description of Artificial Sequence: Synthetic polypeptide
MACPGFLWALVISTCLEFSMASSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGESRPQAYRAGPAQGRSQRDPVPPLLRGAAGQQGHPGVPHQRLLPWRRDRGLEGRQQPREGRRGDHHPQQAEQQQVRRQQLPEPHPRAVEEPPELQLPGDPRGQHRGEDRGPHRVQLIDLSLNR

SEQ ID NO: 7387 - protein, 213 aa, Artificial Sequence
  Description of Artificial Sequence: Synthetic polypeptide
DIQMTQSPSSLSASVGDRVTITCKTSQDINKYMAWYQQTPGKAPRLLIHYTSALQPGIPSRFSGSGSGRDYTFTISSLQPEDIATYYCLQYDNLWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7388 - protein, 214 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7389 - protein, 107 aa, Artificial Sequence
  Description of Artificial Sequence: Synthetic polypeptide
DIELTQSPTTMAASPGEKITITCSASSSISSNYLHWYQQKPGFSPKLLIYRTSNLASGVPARFSGSGSGTSYSLTIGTMEAEDVATYYCQQGSSIPRTRSEGAPSWK

SEQ ID NO: 7390 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIK

SEQ ID NO: 7391 - protein, 108 aa, Artificial Sequence
  Description of Artificial Sequence: Synthetic polypeptide
DIVMTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 7392 - protein, 107 aa, Artificial Sequence
  Description of Artificial Sequence: Synthetic polypeptide
DIQMTQSPKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELK

SEQ ID NO: 7393 - protein, 114 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHGPWTFGGGTKLEIKRA

SEQ ID NO: 7394 - protein, 214 aa, Artificial Sequence
  Description of Artificial Sequence: Synthetic polypeptide
DIQMTQSPSSLSASVGDRVTITCRASESVDDLLHWYQQKPGKAPKLLIKYASQSISGVPSRFSGSGSGTDFTLTISSLQPEDFATYYCQQGNSLPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7395 - protein, 214 aa, Artificial Sequence
  Description of Artificial Sequence: Synthetic polypeptide
DIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7396 - protein, 214 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7397 - protein, 112 aa, Artificial Sequence
  Description of Artificial Sequence: Synthetic polypeptide
AVVLTQTASPVSGVVGGTVTINCQASENIYSRLAWYQQKPGQPPRVLIYYASDLASGVPSRFGGSGSGTDYTLTISDLECADAATYYCHSYYWNSAYSDNTFGGGTEVVVEG

SEQ ID NO: 7398 - protein, 107 aa, Artificial Sequence
  Description of Artificial Sequence: Synthetic polypeptide
DIQMTQSPSSLSTSVGDRVTITCKASQDVSDAVAWFQQKPGKAPKLLIYSPSYRYTGVPSRFTGSGSGTDFTFTISSVQAEDLAVYYCQQHYSTPWTFGQGTKLEIK

SEQ ID NO: 7399 - protein, 108 aa, Artificial Sequence
  Description of Artificial Sequence: Synthetic polypeptide
DIQMTQSPSSLSASVGDRVTITCQASQDISNYLNWYQQKPGKAPKLLIYDASTLETGVPSRFSGSGSGTDFTFTISSLQPEDIATYYCQNYDNLPLTFGGGTKVEIKR

SEQ ID NO: 7400 - protein, 108 aa, Artificial Sequence
  Description of Artificial Sequence: Synthetic polypeptide
DIQMTQSPSSLSASVGDRVTITCRASQNISSFLNWYQQKSGKAPKLLIFATSRLQSGVPSRISGSGSGTDFTLTISGLQPEDFATFYCQQSYSIPLTFGGGTKVDIKR

SEQ ID NO: 7401 - protein, 108 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYDSAPWTFGQGTKVEIKR

SEQ ID NO: 7402 - protein, 101 aa, Artificial Sequence
  Description of Artificial Sequence: Synthetic polypeptide
DIQMTQSPSSLSASVGDRVTITCRASQDISFFLNWYLQKPGQSPQLLIYYTSRYHSGVPSRFSGSGSGTEFTLTISSLQPDDFATYYCQHGNTLPWTFGQG

SEQ ID NO: 7403 - protein, 101 aa, Artificial Sequence
  Description of Artificial Sequence: Synthetic polypeptide
DIQMTQSPSSLSASVGDRVTITCRASQDISFFLNWYQQKPGKAPKLLIYYTSRYHSGVPSRFSGSGSGTEFTLTISSLQSEDFAVYYCQHGNTLPWTFGQG

SEQ ID NO: 7404 - protein, 101 aa, Artificial Sequence
  Description of Artificial Sequence: Synthetic polypeptide
EIVMTQSPATLSVSPGERATLSCRASQDISFFLNWYQQKPGKAPKLLIYYTSRYHSGVPSRFSGSGSGTDFTFTISSLQPEDIATYYCQHGNTLPWTFGQG

SEQ ID NO: 7405 - protein, 101 aa, Artificial Sequence
  Description of Artificial Sequence: Synthetic polypeptide
EIVLTQSPATLSLSPGERATLSCRASQDISFFLNWFQQRPGQSPRRLIYYTSRYHSGIPPRFSGSGYGTDFTLTINNIESEDAAYYFCQHGNTLPWTFGQG

SEQ ID NO: 7406 - protein, 101 aa, Artificial Sequence; identical to SEQ ID NO: 7404
  Description of Artificial Sequence: Synthetic polypeptide

SEQ ID NO: 7407 - protein, 101 aa, Artificial Sequence; identical to SEQ ID NO: 7402
  Description of Artificial Sequence: Synthetic polypeptide

SEQ ID NO: 7408 - protein, 111 aa, Artificial Sequence
  Description of Artificial Sequence: Synthetic polypeptide
AYDLTQTPASVEAAVGGTVTINCQASDNIYSLLAWYQQKPGQPPKLLIYRASTLASGVPSRFKGSGSGTQFTLTISGVECADAATYYCQQHYDYNYLDVAFGGGTEVVVKG

SEQ ID NO: 7409 - protein, 101 aa, Artificial Sequence; identical to SEQ ID NO: 7403
  Description of Artificial Sequence: Synthetic polypeptide

SEQ ID NO: 7410 - protein, 101 aa, Artificial Sequence; identical to SEQ ID NO: 7403
  Description of Artificial Sequence: Synthetic polypeptide

SEQ ID NO: 7411 - protein, 101 aa, Artificial Sequence; identical to SEQ ID NO: 7403
  Description of Artificial Sequence: Synthetic polypeptide

SEQ ID NO: 7412 - protein, 101 aa, Artificial Sequence
  Description of Artificial Sequence: Synthetic polypeptide
DIQMTQSPSSLSASVGDRVTITCRASQDISFFLNWYQQKPGKAPKLLIYYTSRYHSGIPPRFSGSGYGTEFTFTISSLEAEDAATYYCQHGNTLPWTFGQG

SEQ ID NO: 7413 - protein, 101 aa, Artificial Sequence; identical to SEQ ID NO: 7404
  Description of Artificial Sequence: Synthetic polypeptide

SEQ ID NO: 7414 - protein, 101 aa, Artificial Sequence; identical to SEQ ID NO: 7403
  Description of Artificial Sequence: Synthetic polypeptide

SEQ ID NO: 7415 - protein, 108 aa, Artificial Sequence
  Description of Artificial Sequence: Synthetic polypeptide
DIQMTQTTSSLSASLGDRVTISCRASQDISFFLNWYQQKPDGTVKLLIYYTSRYHSGVPSRFSGSGSGTDFSLTINNLEQEDFATYFCQHGNTLPWTFGGGTKLEIKR

SEQ ID NO: 7416 - protein, 101 aa, Artificial Sequence; identical to SEQ ID NO: 7403
  Description of Artificial Sequence: Synthetic polypeptide

SEQ ID NO: 7417 - protein, 101 aa, Artificial Sequence; identical to SEQ ID NO: 7402
  Description of Artificial Sequence: Synthetic polypeptide

SEQ ID NO: 7418 - protein, 101 aa, Artificial Sequence; identical to SEQ ID NO: 7404
  Description of Artificial Sequence: Synthetic polypeptide

SEQ ID NO: 7419 - protein, 111 aa, Artificial Sequence; identical to SEQ ID NO: 7408
  Description of Artificial Sequence: Synthetic polypeptide

SEQ ID NO: 7420 - protein, 101 aa, Artificial Sequence; identical to SEQ ID NO: 7412
  Description of Artificial Sequence: Synthetic polypeptide

SEQ ID NO: 7421 - protein, 108 aa, Artificial Sequence
  Description of Artificial Sequence: Synthetic polypeptide
DIQMTQSPSSLSASLGDRVTITCRASQDISFFLNWYQQKPDGTVKLLIYYTSRYHSGVPSRFSGSGSGTDFTLTISSLQPEDFATYFCQHGNTLPWTFGQGTKLEIKR

SEQ ID NO: 7422 - protein, 108 aa, Artificial Sequence; identical to SEQ ID NO: 7421
  Description of Artificial Sequence: Synthetic polypeptide

SEQ ID NO: 7423 - protein, 156 aa, Artificial Sequence
  Description of Artificial Sequence: Synthetic polypeptide
KEIHQAGKGIKMKSQTQVFVFLLLCVSGAHGSIVMTQTPKFLLVSAGDRITITCKASQSVNNDVAWYQQKPGQSPKLLIYYASNRYTGVPDRFTGSGYGTDFTFTITTVKAEDLAVYFCQQDYSSPLTFGAGTKLELKRADAAPTVSACTKGEFAA

SEQ ID NO: 7424 - protein, 101 aa, Artificial Sequence
  Description of Artificial Sequence: Synthetic polypeptide
DIQMTQTTSSLSASLGDRVTISCRASQDISFFLNWYQQKPDGTVKLLIYYTSRYHSGVPSRFSGSGSGTDFSLTINNLEQEDFATYFCQHGNTLPWTFGGG

SEQ ID NO: 7425 - protein, 108 aa, Artificial Sequence
  Description of Artificial Sequence: Synthetic polypeptide
DVQITQSPSYLAASPGETITINCRASKSISKYLAWYQDKPGKTNKLLIYSGSTLQSGIPSRFSGSGSGTDFTLTISSLEPEDFAMYYCQQHDEYPWTFGGGTKLEIKR

SEQ ID NO: 7426 - protein, 108 aa, Artificial Sequence
  Description of Artificial Sequence: Synthetic polypeptide
DVQITQSPSTLSASPGDRITITCRASKSISKYLAWYQDKPGKTNKLLIYSGSTLQSGIPSRFSGSGSGTEFTLTISSLQPDDFAMYYCQQHDEYPWTFGQGTKLEIKR

SEQ ID NO: 7427 - protein, 108 aa, Artificial Sequence
  Description of Artificial Sequence: Synthetic polypeptide
DVQITQSPSYLSASPGDTITITCRASKSISKYLAWYQDKPGKTNKLLIYSGSTLQSGIPSRFSGSGSGTEFTLTISSLQPDDFAMYYCQQHDEYPWTFGQGTKLEIKR

SEQ ID NO: 7428 - protein, 107 aa, Artificial Sequence
  Description of Artificial Sequence: Synthetic polypeptide
QIVLTQSPAILSASPGEKVTMTCSATSSITYIHWYQQKSGTSPKRWIYDTSRLASGVPTRFSGSGSGTSYSLTISTMEAEDAATYYCQQWSSNPPTFGGGTKLEIKR

SEQ ID NO: 7429 - protein, 106 aa, Artificial Sequence
  Description of Artificial Sequence: Synthetic polypeptide
EIVLTQSPATLSASPGEKVTMTCSATSSITYIHWYQQKSGQSPKRWIYDTSRLASGVPSRFSGSGSGTSYSLTISTMEAEDAATYYCQQWSSNPPTFGGGTKLEIK

SEQ ID NO: 7430 - protein, 111 aa, Artificial Sequence
  Description of Artificial Sequence: Synthetic polypeptide
AYDMTQTPFSVSAAVGGTVTINCQASQNIYSNLAWYQQKPGQRPKLLIYRASTLASGVPSRFSGSRSGTQFTLTISGVECADAATYYCQQHWDYDYIDVAFGGGTEVVVKG

SEQ ID NO: 7431 - protein, 106 aa, Artificial Sequence
  Description of Artificial Sequence: Synthetic polypeptide
EIVLTQSPATLSASPGEKVTMTCSATSSITYIHWYQQKSGTSPKRWIYDTSRLASGVPARFSGSGSGTSYSLTISTMEAEDAATYYCQQWSSNPPTFGGGTKLEIK

SEQ ID NO: 7432 - protein, 106 aa, Artificial Sequence
  Description of Artificial Sequence: Synthetic polypeptide
EIVLTQSPATLSASPGEKVTMTCSATSSITYIHWYQQKPGQAPKRWIYDTSRLASGVPARFSGSGSGTSYSLTISTMEPEDFATYYCQQWSSNPPTFGGGTKLEIK

SEQ ID NO: 7433 - protein, 108 aa, Artificial Sequence
  Description of Artificial Sequence: Synthetic polypeptide
DIQMTQSPSSLSASVGDRVTSTCRASQDISNYLAWYQQKPGKVPKLLIYAASTLQSGVPSRFSGSGSGTDFTLTISSLQPEDVATYYCQKYNSAPWTFGQGTKVEIKR

SEQ ID NO: 7434 - protein, 108 aa, Artificial Sequence
  Description of Artificial Sequence: Synthetic polypeptide
DIQMTQSPSSVSASVGDRVTITCRASQGISSWLAWYQQKPGKAPKLLIYVASSLQSGVPSRFSGSGSGTDFTLTISSLQPEDIATYYCQQADSFPRTFGQGTKVEIKR

SEQ ID NO: 7435 - protein, 111 aa, Artificial Sequence
  Description of Artificial Sequence: Synthetic polypeptide
DVVMTQTPSSVEAAVGGTVTIKCQASENIYSYLAWYQQKPGQPPKLLIYKASYLASGVSSRFKGSGSGTEFTLTISDLECADAATYYCLSTIASASNFDAFGGGTEVVVKG

SEQ ID NO: 7436 - protein, 114 aa, Artificial Sequence
  Description of Artificial Sequence: Synthetic polypeptide
DPVLTQTASSVSAPVGGTVTISCQSSQSVYRSNNVAWYQQKPGKPPKLLIYEASSLASGVPSRFTGSGSGTQFTLTISGVQCDDAATYYCAGGYSSSVDFFFAFGGGTEVVVKG

SEQ ID NO: 7437 - protein, 108 aa, Artificial Sequence
  Description of Artificial Sequence: Synthetic polypeptide
DIVMTQSHKFMSTSVGDRVSISCKASQDVSDAVAWFQQKPGQSPKLLIYSPSYRYTGVPDRFTGSGSGTDFTFTISSVQAEDLAVYYCQQHYSTPWTFGGGTKLEIKR

SEQ ID NO: 7438 - protein, 107 aa, Artificial Sequence
  Description of Artificial Sequence: Synthetic polypeptide
DIQMTQSHKFMSTSVGDRVTITCKASQDVSDAVAWFQQKPGKSPKLLIYSPSYRYTGVPSRFTGSGSGTDFTFTISSVQAEDLAVYYCQQHYSTPWTFGQGTKLEIK

SEQ ID NO: 7439 - protein, 107 aa, Artificial Sequence
  Description of Artificial Sequence: Synthetic polypeptide
DIQMTQSHKFMSTSVGDRVSISCKASQDVSDAVAWFQQKPGKSPKLLIYSPSYRYTGVPSRFTGSGSGTDFTFTISSVQAEDLAVYYCQQHYSTPWTFGQGTKLEIK

SEQ ID NO: 7440 - protein, 217 aa, Artificial Sequence
  Description of Artificial Sequence: Synthetic polypeptide
DIQMTQSPSSLSASVGDRVTITCQASQSINNQLSWYQQKPGKAPKLLIYYASTLASGVPSRFSGSGSGTDFTLTISSLQPEDFATYYCQGSYYSGGWDYGFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7441 - protein, 217 aa, Artificial Sequence; identical to SEQ ID NO: 7440
  Description of Artificial Sequence: Synthetic polypeptide

SEQ ID NO: 7442 - protein, 210 aa, Artificial Sequence
  Description of Artificial Sequence: Synthetic polypeptide
DIQMTQSPSSLSASVGDRVTITCQASQSINNQLSWYQQKPGKAPKLLIYYASTLASGVPSRFSGSGSGTDFTLTISSLQPEDFATYYCQGSYYSGGWDYGFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTK

SEQ ID NO: 7443 - protein, 217 aa, Artificial Sequence; identical to SEQ ID NO: 7440
  Description of Artificial Sequence: Synthetic polypeptide

SEQ ID NO: 7444 - protein, 217 aa, Artificial Sequence; identical to SEQ ID NO: 7440
  Description of Artificial Sequence: Synthetic polypeptide

SEQ ID NO: 7445 - protein, 217 aa, Artificial Sequence; identical to SEQ ID NO: 7440
  Description of Artificial Sequence: Synthetic polypeptide

SEQ ID NO: 7446 - protein, 214 aa, Artificial Sequence
  Description of Artificial Sequence: Synthetic polypeptide
SYELTQPPSVSVAPGQTARISCSGDNLGSKYVDWYQQKPGQAPVLVIYSDNNRPSGIPERFSGSNSGNTATLTISGTQAEDEADYYCQTYTSGNNYLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7447 - protein, 214 aa, Artificial Sequence; identical to SEQ ID NO: 7446
  Description of Artificial Sequence: Synthetic polypeptide

SEQ ID NO: 7448 - protein, 214 aa, Artificial Sequence; identical to SEQ ID NO: 7446
  Description of Artificial Sequence: Synthetic polypeptide

SEQ ID NO: 7449 - protein, 214 aa, Artificial Sequence
  Description of Artificial Sequence: Synthetic polypeptide
SYVLTQPPSVSVAPGKTARISCSGDNLGSKYVDWYQQKPGQAPVLVIYSDNNRPSGIPERFSGSNSGNTATLTISGTQAMDEADYYCATYDSSPRTEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7450 - protein, 214 aa, Artificial Sequence; identical to SEQ ID NO: 7449
  Description of Artificial Sequence: Synthetic polypeptide

SEQ ID NO: 7451 - protein, 214 aa, Artificial Sequence; identical to SEQ ID NO: 7449
  Description of Artificial Sequence: Synthetic polypeptide

SEQ ID NO: 7452 - protein, 214 aa, Artificial Sequence; identical to SEQ ID NO: 7446
  Description of Artificial Sequence: Synthetic polypeptide

SEQ ID NO: 7453 - protein, 214 aa, Artificial Sequence; identical to SEQ ID NO: 7446
  Description of Artificial Sequence: Synthetic polypeptide

SEQ ID NO: 7454 - protein, 214 aa, Artificial Sequence; identical to SEQ ID NO: 7446
  Description of Artificial Sequence: Synthetic polypeptide

SEQ ID NO: 7455 - protein, 214 aa, Artificial Sequence; identical to SEQ ID NO: 7446
  Description of Artificial Sequence: Synthetic polypeptide

SEQ ID NO: 7456 - protein, 214 aa, Artificial Sequence; identical to SEQ ID NO: 7446
  Description of Artificial Sequence: Synthetic polypeptide

SEQ ID NO: 7457 - protein, 216 aa, Artificial Sequence
  Description of Artificial Sequence: Synthetic polypeptide
QSVLTQPPSVSGAPGQRVTISCTGSSSNIGAGYDVHWYQQLPGTAPKLLIHDNSHRPSGVPDRFSGSKSGTSASLAITGLQSEDEADYYCASYDESAHSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7458 - protein, 214 aa, Artificial Sequence; identical to SEQ ID NO: 7449
  Description of Artificial Sequence: Synthetic polypeptide

SEQ ID NO: 7459 - protein, 214 aa, Artificial Sequence; identical to SEQ ID NO: 7449
  Description of Artificial Sequence: Synthetic polypeptide

SEQ ID NO: 7460 - protein, 214 aa, Artificial Sequence; identical to SEQ ID NO: 7449
  Description of Artificial Sequence: Synthetic polypeptide

SEQ ID NO: 7461 - protein, 213 aa, Artificial Sequence
  Description of Artificial Sequence: Synthetic polypeptide
SYELTQPPSVSVAPGQTARISCSGDSIREYYVHWYQQKPGQAPVLVIGDDTNRPSGIPERFSGSNSGNTATLTISGTQAEDEADYYCAAWDFSPAIVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7462 - protein, 214 aa, Artificial Sequence
  Description of Artificial Sequence: Synthetic polypeptide
SYELTQPLSVSVALGQTARITCSGDSIPNYYVYWYQQKPGQAPVLVIYDDSNRPSGIPERFSGSNSGNTATLTISRAQAGDEADYYCQSFDSSLNAEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7463 - protein, 212 aa, Artificial Sequence
  Description of Artificial Sequence: Synthetic polypeptide
SYELTQPPSVSVAPGQTARISCSGDNIGNSYVHWYQQKPGQAPVLVIYKDNDRPSGIPERFSGSNSGNTATLTISGTQAEDEADYYCGTYDIESYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7464 - protein, 447 aa, Artificial Sequence
  Description of Artificial Sequence: Synthetic polypeptide
EVTLKESGPALVKPTQTLTLTCTFSGFSLSTSGGGVSWIRQPPGKALEWLANIDDADIKDYSPSLKSRLTISKDTSKNQVVLTMTNMDPVDTATYYCARGPYGFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7465 - protein, 212 aa, Artificial Sequence
  Description of Artificial Sequence: Synthetic polypeptide
SYELTQPPSVSVAPGQTARISCSGDNIGNSYVHWYQQKPGQAPVLVIYKDNDRPSGIPERFSGSNSGNTATLTISGTQAEDEADYYCATWGSEDQVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7466 - protein, 213 aa, Artificial Sequence
  Description of Artificial Sequence: Synthetic polypeptide
SYELTQPPSVSVAPGQTARISCSGDSLGDYYAYWYQQKPGQAPVLVIYKDNNRPSGIPERFSGSNSGNTATLTISGTQAEDEADYYCQTWDTGESGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7467 - protein, 212 aa, Artificial Sequence
  Description of Artificial Sequence: Synthetic polypeptide
SYVLTQPPSVSVAPGKTARISCSGDNLGSYYVNWYQQKPGQAPVLVIYGDSERPSGIPERFSGSNSGNTATLTISRAQAGDEADYYCGSWDITSFVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7468 - protein, 214 aa, Artificial Sequence; identical to SEQ ID NO: 7449
  Description of Artificial Sequence: Synthetic polypeptide

SEQ ID NO: 7469 - protein, 213 aa, Artificial Sequence
  Description of Artificial Sequence: Synthetic polypeptide
SYVLTQPPSVSVAPGKTARISCSGDSIREYYVHWYQQKPGQAPVLVIGDDTNRPSGIPERFSGSNSGNTATLTISRAQAGDEADYYCAAWDFSPAIVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7470 - protein, 214 aa, Artificial Sequence; identical to SEQ ID NO: 7446
  Description of Artificial Sequence: Synthetic polypeptide

SEQ ID NO: 7471 - protein, 107 aa, Artificial Sequence
  Description of Artificial Sequence: Synthetic polypeptide
DIVLTQSPDSLAVSLGERATINCKASQDVNTAVAWYQQKPDQSPKLLIYWASTRHTGVPARFTGSGSGTDYTLTISSLQAEDVAVYFCQQHHVSPWTFGGGTKVEIK

SEQ ID NO: 7472 - protein, 119 aa, Artificial Sequence
  Description of Artificial Sequence: Synthetic polypeptide
QVQLKQSGAEVKKPGASVKVSCKASGYTFTDEYMNWVRQAPGKSLEWMGYINPNNGGADYNQKFQGRVTMTVDQSISTAYMELSRLRSDDTAVYFCARLGYSNPYFDFWGQGTLVTVSS

SEQ ID NO: 7473 - protein, 107 aa, Artificial Sequence
  Description of Artificial Sequence: Synthetic polypeptide
DIVLTQSPSFLSASVGDRVTITCQASQDVNTAVAWYLQKPGKSPKLLIYWASTRHTGVPARFTGSGSGTDYTLTISSLQPEDFAVYFCQQHHVSPWTFGGGTKVEIK

SEQ ID NO: 7474 - protein, 107 aa, Artificial Sequence
  Description of Artificial Sequence: Synthetic polypeptide
DIVLTQSPATLSLSPGERATLSCRASQDVNTAVAWYQQKPGQSPKLLIYWASTRHTGVPARFTGSGSGTDYTLTISSLQSEDFAVYFCQQHHVSPWTFGGGTKVEIK

SEQ ID NO: 7475 - protein, 119 aa, Artificial Sequence
  Description of Artificial Sequence: Synthetic polypeptide
QVQLVQSGAEVKKPGASVKVSCKASGYTFTDEYMNWVRQAPGQSLEWMGYINPNNGGADYNQKFQGRVTMTVDQSISTAYMELSRLRSDDTAVYFCARLGYSNPYFDFWGQGTLVTVSS

SEQ ID NO: 7476 - protein, 119 aa, Artificial Sequence
  Description of Artificial Sequence: Synthetic polypeptide
QVQLVQSGAEVKKPGASVKVSCKASGYTFTDEYMNWVRQAPGQSLEWMGYINPNNGGADYNPSLKSRVTISVDQSISTAYMELSRLRSDDTAVYFCARLGYSNPYFDFWGQGTLVTVSS

SEQ ID NO: 7477 - protein, 214 aa, Artificial Sequence; identical to SEQ ID NO: 7462
  Description of Artificial Sequence: Synthetic polypeptide

SEQ ID NO: 7478 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSETDFTLTISRLEPEDFAVYYCQQYGSSPEYTFGQGTKLEIKR

SEQ ID NO: 7479 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSRTDFTLTISRLEPEDFAVYYCQQYGSSPEYTFGQGTKLEIKR

SEQ ID NO: 7480 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRREPEDFAVYYCQQYGSSPEYTFGQGTKLEIKR

SEQ ID NO: 7481 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEAEDFAVYYCQQYGSSPEYTFGQGTKLEIKR

SEQ ID NO: 7482 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYDSSPEYTFGQGTKLEIKR

SEQ ID NO: 7483 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSLEYTFGQGTKLEIKR

SEQ ID NO: 7484 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGGSPEYTFGQGTKLEIKR

SEQ ID NO: 7485 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGISPEYTFGQGTKLEIKR

SEQ ID NO: 7486 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPEYTFGQGTKLEIKR

SEQ ID NO: 7487 - protein, 115 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSQYGSSPEYTFGQGTKLEIKR

SEQ ID NO: 7488 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSAEYTFGQGTKLEIKR

SEQ ID NO: 7489 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTEYTFGQGTKLEIKR

SEQ ID NO: 7490 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKLEIKR

SEQ ID NO: 7491 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPDYTFGQGTKLEIKR

SEQ ID NO: 7492 - protein, 116 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPEYGGSPEYTFGQGTKLEIKR

SEQ ID NO: 7493 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPEYTFGQGTKLEIKR

SEQ ID NO: 7494 - protein, 110 aa, Artificial Sequence
  Description of Artificial Sequence: Synthetic polypeptide
EIVLTQSPGTLSLSPGERATLSCRASQSVSISYLAWYQQKPGQAPRLLIYGASSRATGIPDRFSGSGSGTDFTLTISRLEPEDFAVYYCQQYGSSPEYTFGQGTKLEIKR

SEQ ID NO: 7495 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASTRATGIPDRFSGSGSGTDFTLTISRLEPEDFAVYYCQQYGSSPEYTFGQGTKLEIKR

SEQ ID NO: 7496 - protein, 110 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSVTDFTLTISRLEPEDFAVYYCQQYGSSPEYTFGQGTKLEIKR

SEQ ID NO: 7497 - protein, 236 aa, Artificial Sequence
  Description of Artificial Sequence: Synthetic polypeptide
MGWSCIILFLVATATGVHSRDIQMTQSPSSLSASVGDRVTITCGASENIYGALNWYQQKPGKAPKLLIYGATNLADGVPSRFSGSGSGTDFTLTISSLQPEDFATYYCQNVLNTPLTFGQGTKVEIKRTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7498 - protein, 236 aa, Artificial Sequence
  Description of Artificial Sequence: Synthetic polypeptide
MGWSCIILFLVATATGVHSRDIQMTQSPSSLSASVGDRVTITCGASENIYHALNWYQQKPGKAPKLLIYGATNLADGVPSRFSGSGSGTDFTLTISSLQPEDFATYYCQNVLNTPLTFGQGTKVEIKRTRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7499 - protein, 236 aa, Artificial Sequence; identical to SEQ ID NO: 7497
  Description of Artificial Sequence: Synthetic polypeptide

SEQ ID NO: 7500 - protein, 218 aa, Artificial Sequence
  Description of Artificial Sequence: Synthetic polypeptide
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCAQHLSHRTFGGGTKLEIKRTVAAPSVFIFPPSDEQLKSGTASVVCLLNFYPREAKVQWKVDNALQSGNSQESVTEQDSKDSTYSLSSTLTLSKADYEKHKVYACEVTHQGLSSPVTKSFNRGEC

SEQ ID NO: 7501 - protein, 218 aa, Artificial Sequence; identical to SEQ ID NO: 7500
  Description of Artificial Sequence: Synthetic polypeptide

SEQ ID NO: 7502 - protein, 218 aa, Artificial Sequence
  Description of Artificial Sequence: Synthetic polypeptide
NIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCAQYLSSRTFGGGTKLEIKRTVAAPSVFIFPPSDEQLKSGTASVVCLLNFYPREAKVQWKVDNALQSGNSQESVTEQDSKDSTYSLSSTLTLSKADYEKHKVYACEVTHQGLSSPVTKSFNRGEC

SEQ ID NO: 7503 - protein, 218 aa, Artificial Sequence
  Description of Artificial Sequence: Synthetic polypeptide
DIVMTQSPDSLAVSLGERATINCRASESVDSYGNSFMHWYQQKPGQPPKLLIYRASNLESGVPDRFSGSGSGTDFTLTISSLQAEDVAVYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7504 - protein, 218 aa, Artificial Sequence
  Description of Artificial Sequence: Synthetic polypeptide
DIVMTQSPDSLAVSLGERATINCRASESVDSYGNSFMHWYQQKPGQPPKLLIYWASTRESGVPDRFSGSGSGTDFTLTISSLQAEDVAVYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7505 - protein, 218 aa, Artificial Sequence
  Description of Artificial Sequence: Synthetic polypeptide
DIQMTQSPSSLSASVGDRVTITCRASESVDSYGNSFMHWYQQKPGKAPKLLIYRASNLESGVPSRFSGSGSGTDFTLTISSLQPEDFATYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7506 - protein, 214 aa, Artificial Sequence
  Description of Artificial Sequence: Synthetic polypeptide
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7507 - protein, 214 aa, Artificial Sequence
  Description of Artificial Sequence: Synthetic polypeptide
DIVMTQSQRFMSTTVGDRVSITCKASQNVVSAVAWYQQKPGQSPKLLIYSASNRYTGVPDRFTGSGSGTDFTLTISNMQSEDLADFFCQQYSNYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7508 - protein, 219 aa, Artificial Sequence
  Description of Artificial Sequence: Synthetic polypeptide
DVVMTQSPLSLPVTLGQPASISCKSSQSLLDSDGKTFLNWFQQRPGQSPRRLIYLVSKLDSGVPDRFSGSGSGTDFTLKISRVEAEDVGVYYCWQGTHFPYTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7509 - protein, 219 aa, Artificial Sequence
  Description of Artificial Sequence: Synthetic polypeptide
DVLMTQSPLSLPVTPGEPASISCRSSRNIVHINGDTYLEWYLQKPGQSPQLLIYKVSNRFSGVPDRFSGSGSGTDFTLKISRVEAEDVGVYYCFQGSLLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7510 - protein, 113 aa, Artificial Sequence
  Description of Artificial Sequence: Synthetic polypeptide
DIVMTQSPLSLPVSPGEPATINCKSSQSLFNSGNQKNYLAWYLQKPGQPPKLLIYGASTRESGVPDRFSGSGSGTDFTLTISSLQAEDVAVYYCQNDHTYPYTFGQGTKLEIK

SEQ ID NO: 7511 - protein, 113 aa, Artificial Sequence
  Description of Artificial Sequence: Synthetic polypeptide
DIVLTQSPSSLSVSAGEKVTMDCKSSQSLFNSGNQKNYLAWYHQKPGQPPKLLIYGASTRESGVPDRFTGSGSGTDFTLTISSVQAEDLAVYYCQNDHTYPYTFGGGTKLEIK

SEQ ID NO: 7512 - protein, 106 aa, Artificial Sequence
  Description of Artificial Sequence: Synthetic polypeptide
DIQMTQSPSSLSASLGGKVTITCKASQDINKYISWYQDKPGKGPGLLIHYTSTLQPGIPSRFSGSGSGRDYSFSISNLEPEDIATYYCLQYDNLYTFGGGTKLEIK

SEQ ID NO: 7513 - protein, 214 aa, Artificial Sequence
  Description of Artificial Sequence: Synthetic polypeptide
DIVMTQSPSSMSASIGDRVTITCRASQGITSWLAWYQQKPGKAPNLLIYGSSSLQSGVPSRFSGSGSGTEFTLTISSLQPEDFATYYCQQGYSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7514 - protein, 120 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRLTISRDNSKNTLYLQMNSLRAEDTAVYYCARHYYYGGSYAMDYWGQGTLVTVSS

SEQ ID NO: 7515 - protein, 214 aa, Artificial Sequence
  Description of Artificial Sequence: Synthetic polypeptide
DIQMTQSPSSLSASVGDRVTITCRASQDISKFLNWYQQKPGKAIKLLIYHTSRLHSGVPSRFSGSGSGTDFTLTISSLQPEDFATYYCQQGATLPYTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7516 - protein, 214 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7517 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDFTLTISSLQPEDFATYFCQQGNTLPYTFGPGTKVDIK

SEQ ID NO: 7518 - protein, 107 aa, Artificial Sequence
  Description of Artificial Sequence: Synthetic polypeptide
DIQMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGPGTKVDIK

SEQ ID NO: 7519 - protein, 120 aa, Artificial Sequence
  Description of Artificial Sequence: Synthetic polypeptide
QVQLVESGGGVVQPGRSLRLSCAASGVSLPDYGVSWVRQAPGKGLEWVAVIWGSETTYYNSALKSRFTISRDNSKNTLYLQMNSLRAEDTAVYYCARHYYYGGSYAMDYWGQGTLVTVSS

SEQ ID NO: 7520 - protein, 213 aa, Artificial Sequence
  Description of Artificial Sequence: Synthetic polypeptide
EIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7521 - protein, 114 aa, Artificial Sequence
  Description of Artificial Sequence: Synthetic polypeptide
ELVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRRS

SEQ ID NO: 7522 - protein, 114 aa, Artificial Sequence
  Description of Artificial Sequence: Synthetic polypeptide
ELVLTQSPASLAVSLGQRATISCRASQSVDNYGISFMNWFQQKPGQPPKLLIYAASNQGSGVPARFSGSGSGTDFSLNIHPMEEDDTAMYFCQQSKEVPRTFGGGTKLEIKRRS

SEQ ID NO: 7523 - protein, 211 aa, Artificial Sequence
  Description of Artificial Sequence: Synthetic polypeptide
EIVLTQSPAIMSASPGERVTMTCSASSGVNYMHWYQQKPGTSPRRWIYDTSKLASGVPARFSGSGSGTDYSLTISSMEPEDAATYYCHQRGSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7524 - protein, 218 aa, Artificial Sequence
  Description of Artificial Sequence: Synthetic polypeptide
EIVLTQSPDFQSVTPKEKVTITCRASESVDTFGISFMNWFQQKPDQSPKLLIHEASNQGSGVPSRFSGSGSGTDFTLTINSLEAEDAATYYCQQSKEVPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7525 - protein, 125 aa, Artificial Sequence
  Description of Artificial Sequence: Synthetic polypeptide
MGWSCIILFLVATATGVHSDIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIK

SEQ ID NO: 7526 - protein, 213 aa, Artificial Sequence
  Description of Artificial Sequence: Synthetic polypeptide
QIVMSQSPAILSASPGEKVTMTCRARSSVSYIHWYQQKPGSSPKPWIYATSNLASGVPGRFSGSGSGTSYSLTITRVEAEDAATYYCQQWSSKPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7527 - protein, 232 aa, Artificial Sequence
  Description of Artificial Sequence: Synthetic polypeptide
MGWSCIILFLVATATGVHSDIQMTQSPSSLSASVGDRVTITCRASSSVSYMHWYQQKPGKAPKPLIYAPSNLASGVPSRFSGSGSGTDFTLTISSLQPEDFATYYCQQWSFNPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7528 - protein, 219 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7529 - protein, 209 aa, Artificial Sequence
  Description of Artificial Sequence: Synthetic polypeptide
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRADAAPTVFIFPPSDEQLKSGTASVVCLLNNFYPREAKVQWKVDNALQSGNSQESVTEQDSKDSTYSLSSTLTLSKADYEKHKVYACEVTHQGLSSPVTKSFN

SEQ ID NO: 7530 - protein, 213 aa, Artificial Sequence
  Description of Artificial Sequence: Synthetic polypeptide
DIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7531 - protein, 232 aa, Artificial Sequence
  Description of Artificial Sequence: Synthetic polypeptide
MGWSCIILFLVATATGVHSDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7532 - protein, 238 aa, Artificial Sequence
  Description of Artificial Sequence: Synthetic polypeptide
ALPAQLLGLLMLWVSGSSGDIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7533 - protein, 108 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHFGPGTKVDIK

SEQ ID NO: 7534 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPLTFGGGTKVEIK

SEQ ID NO: 7535 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPITFGQGTRLEIK

SEQ ID NO: 7536 - protein, 110 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFTFGGGTKVEIK

SEQ ID NO: 7537 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPITFGQGTRLEIK

SEQ ID NO: 7538 - protein, 105 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWTFGGGTKVEIK

SEQ ID NO: 7539 - protein, 107 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVFGGGTKLTVL

SEQ ID NO: 7540 - protein, 114 aa, Artificial Sequence
  Description of Artificial Sequence: Synthetic polypeptide
QPVLTQPTSLSASPGASARLTCTLRSGINLGSYRIFWYQQKPESPPRYLLSYYSDSSKHQGSGVPSRFSGSKDASSNAGILVISGLQSEDEADYYCMIWHSSAVFGGGTKLTVL

SEQ ID NO: 7541 - protein, 218 aa, Artificial Sequence
  Description of Artificial Sequence: Synthetic polypeptide
DIVLTQSPASLAVSLGQRATISCRASGSVDSFGNSFMHWYQQKPGQPPKLLIYRASNLESGVPARFSGGGSRTDFTLTINPVEADDIATYFCQQSYEDPFTFGAGTKLELMRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7542 - protein, 218 aa, Artificial Sequence
  Description of Artificial Sequence: Synthetic polypeptide
DIVLTQSPASLAVSLGQRAIISCRASESVDNFGNSFMHWYQQKPGQPPTLLIYRASNLESGIPARFSGSGSRTDFTLTVNPVEADDIATYYCQQSYEDPFTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7543 - protein, 112 aa, Artificial Sequence
  Description of Artificial Sequence: Synthetic polypeptide
DIVLTQSPASLAVSLGQRATISCRASGSVDSFGNSFMHWYQQKPGQPPKLLIYRASNLESGVPARFSGGGSRTDFTLTINPVEADDIATYFCQQSYEDPFTFGAGTKLELMR

SEQ ID NO: 7544 - protein, 112 aa, Artificial Sequence
  Description of Artificial Sequence: Synthetic polypeptide
DIVLTQSPASLAVSPGQRATISCRASGSVDSFGNSFMHWYQQKPGQPPKLLIYRASNLESGVPARFSGGGSRTDFTLTINPVEANDIATYFCQQSYEDPFTFGQGTKLELKR

SEQ ID NO: 7545 - protein, 112 aa, Artificial Sequence
  Description of Artificial Sequence: Synthetic polypeptide
DIVLTQSPASLAVSLGQRAIISCRASESVDNFGNSFMHWYQQKPGQPPTLLIYRASNLESGIPARFSGSGSRTDFTLTVNPVEADDIATYYCQQSYEDPFTFGAGTKLELKR

SEQ ID NO: 7546 - protein, 218 aa, Artificial Sequence
  Description of Artificial Sequence: Synthetic polypeptide
DIVLTQSPASLAVSPGQRATISCRASGSVDSFGNSFMHWYQQKPGQPPKLLIYRASNLESGVPARFSGGGSRTDFTLTINPVEANDIATYFCQQSYEDPFTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7547 - protein, 112 aa, Artificial Sequence; identical to SEQ ID NO: 7543
  Description of Artificial Sequence: Synthetic polypeptide

SEQ ID NO: 7548 - protein, 214 aa, Artificial Sequence
  Description of Artificial Sequence: Synthetic polypeptide
DIVMTQSQKFMSTSVGDRVSVNCKASQNVGTNVAWYQQKPRQSPKGLIYSASFRYSGVPDRFTGSGSGTDFTLTIFNVQSDDLAEYFCQQYNNYPLTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7549 - protein, 214 aa, Artificial Sequence
  Description of Artificial Sequence: Synthetic polypeptide
DIQMTQSPSTMSTSVGDRVSVNCKASQNVGTNVAWYQQKPGKSPKGLIYSASFRYSGVPSRFTGSGSGTDFTLTIFNVQPDDLAEYFCQQYNNYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7550 - protein, 108 aa, Artificial Sequence
  Description of Artificial Sequence: Synthetic polypeptide
DIQMTQSPSTMSTSVGDRVSVNCKASQNVGTNVAWYQQKPGKSPKGLIYSASFRYSGVPSRFTGSGSGTDFTLTIFNVQPDDLAEYFCQQYNNYPLTFGGGTKLEIKR

SEQ ID NO: 7551 - protein, 214 aa, Artificial Sequence
  Description of Artificial Sequence: Synthetic polypeptide
DIKMTQSPSSMYTSLGERVTITCKASQDINSFLSWFQQKPGKSPKTLIYRAYRLVDGVPSRFSGSGSGQDYSLTISSLEFEDMGIYYCLQSGAFPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7552 - protein, 108 aa, Artificial Sequence
  Description of Artificial Sequence: Synthetic polypeptide
DIVMTQSQKFMSTSVGDRVSVNCKASQNVGTNVAWYQQKPRQSPKGLIYSASFRYSGVPDRFTGSGSGTDFTLTIFNVQSDDLAEYFCQQYNNYPLTFGGGTKLEIKR

SEQ ID NO: 7553 - protein, 108 aa, Artificial Sequence
  Description of Artificial Sequence: Synthetic polypeptide
DIKMTQSPSSMYTSLGERVTITCKASQDINSFLSWFQQKPGKSPKTLIYRAYRLVDGVPSRFSGSGSGQDYSLTISSLEFEDMGIYYCLQSGAFPLTFGAGTKLELKR

SEQ ID NO: 7554 - protein, 213 aa, Artificial Sequence
  Description of Artificial Sequence: Synthetic polypeptide
QIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7555 - protein, 239 aa, Artificial Sequence
  Description of Artificial Sequence: Synthetic polypeptide
MALPAQLLGLLMLWVSGSSGDIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7556 - protein, 239 aa, Artificial Sequence
  Description of Artificial Sequence: Synthetic polypeptide
MALLAQLLGLLMLWVPGSSGAIVMTQPPLSSPVTLGQPASISCRSSQSLVHSDGNTYLNWLQQRPGQPPRLLIYKFFRRLSGVPDRFSGSGAGTDFTLKISRVEAEDVGVYYCMQVTQFPHTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7557 - protein, 213 aa, Artificial Sequence
  Description of Artificial Sequence: Synthetic polypeptide
QIVLSQSPSSLSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7558 - protein, 213 aa, Artificial Sequence
  Description of Artificial Sequence: Synthetic polypeptide
QIQLSQSPSILSASPGEKVTMTCRASSSVSYIHWFQQKPGSSPKPWIYATSNLASGVPSRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7559 - protein, 213 aa, Artificial Sequence
  Description of Artificial Sequence: Synthetic polypeptide
QIQLSQSPSSLSASPGEKVTMTCRASSSVSYIHWFQQKPGSSPKPWIYATSNLASGVPSRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7560 - protein, 213 aa, Artificial Sequence
  Description of Artificial Sequence: Synthetic polypeptide
QIQLSQSPSILSASPGEKVTMTCRASSSVSYIHWFQQKPGSSPKPWIYATSNLASGVPSRFSGSGSGTSYSLTISRVEAEDAATYYCQQWTSNPPTFGGGTKLEIKRTVAAPSVFIFPPSDEQLKSGTASVVCLLNNFYPREAKVQWKVDNADQSGNSQESVTEQDSKDSTYSLSSTLTLSKADYEKHKVYACEVTHQGLSSPVTKSFNRGEC

SEQ ID NO: 7561 - protein, 213 aa, Artificial Sequence
  Description of Artificial Sequence: Synthetic polypeptide
QIQLSQSPSSLSASPGEKVTMTCRASSSVSYIHWFQQKPGSSPKPWIYATSNLASGVPSRFSGSGSGTSYSLTISRVEAEDAATYYCQQWTSNPPTFGGGTKLEIKRTVAAPSVFIFPPSDEQLKSGTASVVCLLNNFYPREAKVQWKVDNADQSGNSQESVTEQDSKDSTYSLSSTLTLSKADYEKHKVYACEVTHQGLSSPVTKSFNRGEC

SEQ ID NO: 7562 - protein, 213 aa, Artificial Sequence
  Description of Artificial Sequence: Synthetic polypeptide
  MOD_RES (3)..(3): Any amino acid
QIXLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7563 - protein, 213 aa, Artificial Sequence
  Description of Artificial Sequence: Synthetic polypeptide
  MOD_RES (9)..(9): Any amino acid
QIVLSQSPXILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7564 - protein, 213 aa, Artificial Sequence
  Description of Artificial Sequence: Synthetic polypeptide
  MOD_RES (10)..(10): Any amino acid
QIVLSQSPAXLSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7565 - protein, 213 aa, Artificial Sequence
  Description of Artificial Sequence: Synthetic polypeptide
  MOD_RES (59)..(59): Any amino acid
QIVLSQSPAILSASPGEKVTMTCRASSSVSYIHWFQQKPGSSPKPWIYATSNLASGVPXRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7566 - protein, 213 aa, Artificial Sequence
  Description of Artificial Sequence: Synthetic polypeptide
  MOD_RES (153)..(153): Any amino acid
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNAXQSGNSQESVTEQDSKDSTYSLSSTLTLSKADYEKHKVYACEVTHQGLSSPVTKSFNRGEC

SEQ ID NO: 7567 - protein, 213 aa, Artificial Sequence
  Description of Artificial Sequence: Synthetic polypeptide
  MOD_RES (9)..(10): Any amino acid
QIVLSQSPXXLSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7568 - protein, 213 aa, Artificial Sequence
  Description of Artificial Sequence: Synthetic polypeptide
  MOD_RES (3)..(3): Any amino acid
  MOD_RES (9)..(9): Any amino acid
  MOD_RES (59)..(59): Any amino acid
QIXLSQSPXILSASPGEKVTMTCRASSSVSYIHWFQQKPGSSPKPWIYATSNLASGVPXRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7569 - protein, 213 aa, Artificial Sequence
  Description of Artificial Sequence: Synthetic polypeptide
  MOD_RES (3)..(3): Any amino acid
  MOD_RES (9)..(10): Any amino acid
  MOD_RES (59)..(59): Any amino acid
QIXLSQSPXXLSASPGEKVTMTCRASSSVSYIHWFQQKPGSSPKPWIYATSNLASGVPXRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7570 - protein, 213 aa, Artificial Sequence
  Description of Artificial Sequence: Synthetic polypeptide
  MOD_RES (3)..(3): Any amino acid
  MOD_RES (9)..(9): Any amino acid
  MOD_RES (59)..(59): Any amino acid
  MOD_RES (153)..(153): Any amino acid
QIXLSQSPXILSASPGEKVTMTCRASSSVSYIHWFQQKPGSSPKPWIYATSNLASGVPXRFSGSGSGTSYSLTISRVEAEDAATYYCQQWTSNPPTFGGGTKLEIKRTVAAPSVFIFPPSDEQLKSGTASVVCLLNNFYPREAKVQWKVDNAXQSGNSQESVTEQDSKDSTYSLSSTLTLSKADYEKHKVYACEVTHQGLSSPVTKSFNRGEC

SEQ ID NO: 7571 - protein, 213 aa, Artificial Sequence
  Description of Artificial Sequence: Synthetic polypeptide
  MOD_RES (3)..(3): Any amino acid
  MOD_RES (9)..(10): Any amino acid
  MOD_RES (59)..(59): Any amino acid
  MOD_RES (153)..(153): Any amino acid
QIXLSQSPXXLSASPGEKVTMTCRASSSVSYIHWFQQKPGSSPKPWIYATSNLASGVPXRFSGSGSGTSYSLTISRVEAEDAATYYCQQWTSNPPTFGGGTKLEIKRTVAAPSVFIFPPSDEQLKSGTASVVCLLNNFYPREAKVQWKVDNAXQSGNSQESVTEQDSKDSTYSLSSTLTLSKADYEKHKVYACEVTHQGLSSPVTKSFNRGEC

SEQ ID NO: 7572 - protein, 214 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7573 - protein, 214 aa, Artificial Sequence
  Description of Artificial Sequence: Synthetic polypeptide
DIQLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7574 - protein, 214 aa, Artificial Sequence
  Description of Artificial Sequence: Synthetic polypeptide
DILLTQSPSILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7575 - protein, 214 aa, Artificial Sequence
  Description of Artificial Sequence: Synthetic polypeptide
DILLTQSPVSLSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7576 - protein, 213 aa, Artificial Sequence
  Description of Artificial Sequence: Synthetic polypeptide
QIQLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7577 - protein, 214 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNADQSGNSQESVTEQDSKDSTYSLSSTLTLSKADYEKHKVYACEVTHQGLSSPVTKSFNRGEC

SEQ ID NO: 7578 - protein, 214 aa, Artificial Sequence; identical to SEQ ID NO: 7572
  Description of Artificial Sequence: Synthetic polypeptide

SEQ ID NO: 7579 - protein, 214 aa, Artificial Sequence; identical to SEQ ID NO: 7572
  Description of Artificial Sequence: Synthetic polypeptide

SEQ ID NO: 7580 - protein, 214 aa, Artificial Sequence; identical to SEQ ID NO: 7572
  Description of Artificial Sequence: Synthetic polypeptide

SEQ ID NO: 7581 - protein, 214 aa, Artificial Sequence; identical to SEQ ID NO: 7572
  Description of Artificial Sequence: Synthetic polypeptide

SEQ ID NO: 7582 - protein, 214 aa, Artificial Sequence; identical to SEQ ID NO: 7572
  Description of Artificial Sequence: Synthetic polypeptide

SEQ ID NO: 7583 - protein, 213 aa, Artificial Sequence
  Description of Artificial Sequence: Synthetic polypeptide
QIVLSQSPSILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7584 - protein, 214 aa, Artificial Sequence
  Description of Artificial Sequence: Synthetic polypeptide
  MOD_RES (3)..(3): Any amino acid
DIXLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7585 - protein, 214 aa, Artificial Sequence
  Description of Artificial Sequence: Synthetic polypeptide
  MOD_RES (9)..(9): Any amino acid
DILLTQSPXILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7586 - protein, 214 aa, Artificial Sequence
  Description of Artificial Sequence: Synthetic polypeptide
  MOD_RES (10)..(10): Any amino acid
DILLTQSPVXLSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7587 - protein, 214 aa, Artificial Sequence
  Description of Artificial Sequence: Synthetic polypeptide
  MOD_RES (154)..(154): Any amino acid
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNAXQSGNSQESVTEQDSKDSTYSLSSTLTLSKADYEKHKVYACEVTHQGLSSPVTKSFNRGEC

SEQ ID NO: 7588 - protein, 214 aa, Artificial Sequence
  Description of Artificial Sequence: Synthetic polypeptide
  MOD_RES (9)..(10): Any amino acid
DILLTQSPXXLSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7589 - protein, 214 aa, Artificial Sequence
  Description of Artificial Sequence: Synthetic polypeptide
  MOD_RES (3)..(3): Any amino acid
  MOD_RES (9)..(9): Any amino acid
DIXLTQSPXILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7590 - protein, 214 aa, Artificial Sequence
  Description of Artificial Sequence: Synthetic polypeptide
  MOD_RES (3)..(3): Any amino acid
  MOD_RES (9)..(10): Any amino acid
DIXLTQSPXXLSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7591 - protein, 214 aa, Artificial Sequence
  Description of Artificial Sequence: Synthetic polypeptide
  MOD_RES (3)..(3): Any amino acid
  MOD_RES (9)..(9): Any amino acid
  MOD_RES (154)..(154): Any amino acid
DIXLTQSPXILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNAXQSGNSQESVTEQDSKDSTYSLSSTLTLSKADYEKHKVYACEVTHQGLSSPVTKSFNRGEC

SEQ ID NO: 7592 - protein, 213 aa, Artificial Sequence
  Description of Artificial Sequence: Synthetic polypeptide
QIVLSQSPASLSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7593 - protein, 214 aa, Artificial Sequence
  Description of Artificial Sequence: Synthetic polypeptide
  MOD_RES (3)..(3): Any amino acid
  MOD_RES (9)..(10): Any amino acid
  MOD_RES (154)..(154): Any amino acid
DIXLTQSPXXLSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNAXQSGNSQESVTEQDSKDSTYSLSSTLTLSKADYEKHKVYACEVTHQGLSSPVTKSFNRGEC

SEQ ID NO: 7594 - protein, 213 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPSRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7595 - protein, 213 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNADQSGNSQESVTEQDSKDSTYSLSSTLTLSKADYEKHKVYACEVTHQGLSSPVTKSFNRGEC

SEQ ID NO: 7596 - protein, 214 aa, Artificial Sequence
  Description of Artificial Sequence: Synthetic polypeptide
DIQMTQSPSSLSASIGDRVTITCKASQDINSYLSWFQQKPGKAPKLLIYRANRLVDGVPSRFSGSGSGTDYTLTISSLQPEDFAVYYCLQYDEFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7597 - protein, 239 aa, Artificial Sequence
  Description of Artificial Sequence: Synthetic polypeptide
MKLPVRLLVLLLFWIPASRGDVQVTQSPSSLSASVGDRVTITCRSSQSLANSYGNTFLSWYLHKPGKAPQLLIYGISNRFSGVPDRFSGSGSGTDFTLTISSLQPEDFATYYCLQGTHQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7598 - protein, 219 aa, Artificial Sequence
  Description of Artificial Sequence: Synthetic polypeptide
DIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7599 - protein, 113 aa, Artificial Sequence
  Description of Artificial Sequence: Synthetic polypeptide
DVQVTQSPSSLSASVGDRVTITCRSSQSLANSYGNTFLSWYLHKPGKAPQLLIYGISNRFSGVPDRFSGSGSGTDFTLTISSLQPEDFATYYCLQGTHQPYTFGQGTKVEIKR

SEQ ID NO: 7600 - protein, 113 aa, Artificial Sequence
  Description of Artificial Sequence: Synthetic polypeptide
DVVVTQSPSSLSASVGDRVTITCRSSQSLANSYGNTFLSWYLHKPGKAPQLLIYGISNRFSGVPDRFSGSGSGTDFTLTISSLQPEDFATYYCLQGTHQPYTFGQGTKVEIKR

SEQ ID NO: 7601 - protein, 239 aa, Artificial Sequence; identical to SEQ ID NO: 7597
  Description of Artificial Sequence: Synthetic polypeptide

SEQ ID NO: 7602 - protein, 108 aa, Artificial Sequence
  Description of Artificial Sequence: Synthetic polypeptide
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGCGTKLEIK

SEQ ID NO: 7603 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7604 - protein, 215 aa, Artificial Sequence
  Description of Artificial Sequence: Synthetic polypeptide
DIQMTQSPSSLSASVGDRVTITCRASQNVGTAVAWLQQTPGKAPKLLIYSASNRYTGVPSRFSGSGSGTDYTFTISSLQPEDIATYYCQQYTNYPMYTFGQGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7605 - protein, 214 aa, Artificial Sequence
  Description of Artificial Sequence: Synthetic polypeptide
DIQMTQSPSSLSASVGDRVTITCRASQGISRWLAWYQQKPEKAPKSLIYAASSLQSGVPSRFSGSGSGTDFTLTISSLQPEDFATYYCQQYNTYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7606 - protein, 216 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 7607 - protein, 214 aa, Artificial Sequence
  Description of Artificial Sequence: Synthetic polypeptide
DIQMTQSPSSLSASVGDRVTITCHASQNIYVWLNWYQQKPGKAPKLLIYKASNLHTGVPSRFSGSGSGTDFTLTISSLQPEDFATYYCQQGQTYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7608 - protein, 447 aa, Artificial Sequence
  Description of Artificial Sequence: Synthetic polypeptide
QVQLVQSGAEVKKPGASVKVSCKVSGYTFTDYYITWVRQAPGQALEWMGWIYPGSGNTKYSQKFQGRFVFSVDTSASTAYLQISSLKAEDTAVYYCANYGNYWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVQFNWYVDGVEVHNAKTKPREEQFNSTFRVVSVLTVVHQDWLNGKEYKCKVSNKALPAPEEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 7609 - protein, 214 aa, Artificial Sequence
  Description of Artificial Sequence: Synthetic polypeptide
DIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7610 - protein, 214 aa, Artificial Sequence
  Description of Artificial Sequence: Synthetic polypeptide
DIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7611 - protein, 214 aa, Artificial Sequence; identical to SEQ ID NO: 7610
  Description of Artificial Sequence: Synthetic polypeptide

SEQ ID NO: 7612 - protein, 214 aa, Artificial Sequence; identical to SEQ ID NO: 7609
  Description of Artificial Sequence: Synthetic polypeptide

SEQ ID NO: 7613 - protein, 214 aa, Artificial Sequence
  Description of Artificial Sequence: Synthetic polypeptide
DIVMTQSHKLLSTSVGDRVSITCKASQDVSTAVDWYQQKPGQSPKLLINWASTRHTGVPDRFTGSGSGTDYTLTISSMQAEDLALYYCRQHYSTPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7614 - protein, 214 aa, Artificial Sequence
  Description of Artificial Sequence: Synthetic polypeptide
DIQMTQSPSSLSVSVGERVTITCRASENIRSNLAWYQQKPGKSPKLLVNVATNLADGVPSRFSGSGSGTDYSLKINSLQPEDFGTYYCQHYWGTTWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7615 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7616 - protein, 214 aa, Artificial Sequence
  Description of Artificial Sequence: Synthetic polypeptide
DIVMTQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7617 - protein, 214 aa, Artificial Sequence; identical to SEQ ID NO: 7615
  Description of Artificial Sequence: Synthetic polypeptide

SEQ ID NO: 7618 - protein, 219 aa, Artificial Sequence
  Description of Artificial Sequence: Synthetic polypeptide
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7619 - protein, 238 aa, Artificial Sequence
  Description of Artificial Sequence: Synthetic polypeptide
MGWSCIILFLVATATGVHSDIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7620 - protein, 239 aa, Artificial Sequence; identical to SEQ ID NO: 7555
  Description of Artificial Sequence: Synthetic polypeptide

SEQ ID NO: 7621 - protein, 239 aa, Artificial Sequence; identical to SEQ ID NO: 7555
  Description of Artificial Sequence: Synthetic polypeptide

SEQ ID NO: 7622 - protein, 219 aa, Artificial Sequence
  Description of Artificial Sequence: Synthetic polypeptide
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7623 - protein, 444 aa, Artificial Sequence
  Description of Artificial Sequence: Synthetic polypeptide
EVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7624 - protein, 470 aa, Artificial Sequence
  Description of Artificial Sequence: Synthetic polypeptide
MGWSCIILFLVATATGVHSQVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7625 - protein, 238 aa, Artificial Sequence
  Description of Artificial Sequence: Synthetic polypeptide
MEAPAQLLFLLLLWLPDTTGDIVMTQTPLSLSVTPGQPASISCKSSQSLLYSNGKTYLNWLLQKPGQSPQRLIYLVSKLDSGVPDRFSGSGSGTDFTLKISRVEAEDVGVYYCVQGTHLHTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7626 - protein, 239 aa, Artificial Sequence
  Description of Artificial Sequence: Synthetic polypeptide
MEAPAQLLFLLLLWLPDTTGDIVMTQTPLSLSVTPGQPASISCRSSQSLVHTNGNSYLHWYLQKPGQSPQLLIYMVSNRFSGVPDRFSGSGSGTDFTLKISRVEAEDVGVYYCSQSTHVPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7627 - protein, 239 aa, Artificial Sequence
  Description of Artificial Sequence: Synthetic polypeptide
MEAPAQLLFLLLLWLPDTTGDIVMTQTPLSLSVTPGQPASISCKSSQSLLDSDGKTYLNWLLQKPGQSPQRLIYLVSALDSGVPDRFSGSGSGTDFTLKISRVEAEDVGVYYCWQGTHFPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7628 - protein, 238 aa, Artificial Sequence
  Description of Artificial Sequence: Synthetic polypeptide
MEAPAQLLFLLLLWLPDTTGDIVMTQTPLSLSVTPGQPASISCKSSQSLLYSNGKTYLNWVLQKPGQSPQRLIYLVSKLDSGVPDRFSGSGSGTDFTLKISRVEAEDVGVYYCVQGSHFHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7629 - protein, 240 aa, Artificial Sequence
  Description of Artificial Sequence: Synthetic polypeptide
MEAPAQLLFLLLLWLPDTTGDIVMTQTPLSLSVTPGQPASISCRSSQSLVHTNGNTYLHWYLQKPGQSPQLLIYMVSNRFSGVPDRFSGSGSGTDFTLKISRVEAEDVGVYYCSQSAHVPPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7630 - protein, 214 aa, Artificial Sequence
  Description of Artificial Sequence: Synthetic polypeptide
DIQMTQSPSSLSASVGDRVTITCRASQDISNYLAWYQQKPGKAPKLLIYYTSKIHSGVPSRFSGSGSGTDYTFTISSLQPEDIATYYCQQGNTFPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7631 - protein, 218 aa, Artificial Sequence
  Description of Artificial Sequence: Synthetic polypeptide
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7632 - protein, 219 aa, Artificial Sequence
  Description of Artificial Sequence: Synthetic polypeptide
DIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7633 - protein, 218 aa, Artificial Sequence
  Description of Artificial Sequence: Synthetic polypeptide
DIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7634 - protein, 107 aa, Artificial Sequence
  Description of Artificial Sequence: Synthetic polypeptide
AIQLTQSPSSLSASVGDRVTITCRASQGISSALAWYQQKPGKAPKLLIYGASSLEGGVPSRFSGSGSGTDFTLTISSLQPEDFATYYCQQFNSYPFTFGPGTKVDIK

SEQ ID NO: 7635 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPYTFGQGTKLEIK

SEQ ID NO: 7636 - protein, 213 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7637 - protein, 213 aa, Artificial Sequence
  Description of Artificial Sequence: Synthetic polypeptide
DIQMTQSPSSLSASVGDRVTITCRASEDVNTYVSWYQQKPGKAPKLLIYAASNRYTGVPSRFSGSGSGTDFTLTISSLQPEDFATYYCQQSFSYPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7638 - protein, 214 aa, Artificial Sequence
  Description of Artificial Sequence: Synthetic polypeptide
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7639 - protein, 214 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7640 - protein, 214 aa, Artificial Sequence
  Description of Artificial Sequence: Synthetic polypeptide
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7641 - protein, 218 aa, Artificial Sequence
  Description of Artificial Sequence: Synthetic polypeptide
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7642 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQHRSNWPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7643 - protein, 215 aa, Artificial Sequence
  Description of Artificial Sequence: Synthetic polypeptide
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7644 - protein, 219 aa, Artificial Sequence
  Description of Artificial Sequence: Synthetic polypeptide
DIQMTQSPSSLSASVGDRVTITCRTSQSLVHINAITYLHWYQQKPGKAPKLLIYRVSNRFSGVPSRFSGSGSGTDFTLTISSLQPEDFATYYCGQSTHVPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7645 - protein, 213 aa, Artificial Sequence
  Description of Artificial Sequence: Synthetic polypeptide
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7646 - protein, 214 aa, Artificial Sequence
  Description of Artificial Sequence: Synthetic polypeptide
EIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7647 - protein, 214 aa, Artificial Sequence
  Description of Artificial Sequence: Synthetic polypeptide
DIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7648 - protein, 219 aa, Artificial Sequence
  Description of Artificial Sequence: Synthetic polypeptide
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7649 - protein, 481 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTRHRQPRGWEQLYNTVSFNLGEAYEYPTFIQDLRNELAKGTPVCQLPVTLQTIADDKRFVLVDITTTSKKTVKVAIDVTDVYVVGYQDKWDGKDRAVFLDKVPTVATSKLFPGVTNRVTLTFDGSYQKLVNAAKADRKALELGVNKLEFSIEAIHGKTINGQEAAKFFLIVIQMVSEAARFKYIETEVVDRGLYGSFKPNFKVLNLENNWGDISDAIHKSSPQCTTINPALQLISPSNDPWVVNKVSQISPDMGILKFKSSK

SEQ ID NO: 7650 - protein, 214 aa, Artificial Sequence
  Description of Artificial Sequence: Synthetic polypeptide
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7651 - protein, 214 aa, Artificial Sequence
  Description of Artificial Sequence: Synthetic polypeptide
DIQMTQSPSFLSASVGDRVTITCRASQGIISYLAWYQQKPEKAPKRLIYAASSLQSGVPSRFSGSGSGTEFTLTISSLQPEDFATYYCGQYANYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7652 - protein, 214 aa, Artificial Sequence
  Description of Artificial Sequence: Synthetic polypeptide
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7653 - protein, 214 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7654 - protein, 214 aa, Artificial Sequence
  Description of Artificial Sequence: Synthetic polypeptide
DIQMTQSPSSLSASVGDRVTITCRASQNIATDVAWYQQKPGKAPKLLIYSASFLYSGVPSRFSGSGSGTDFTLTISSLQPEDFATYYCQQSEPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7655 - protein, 214 aa, Artificial Sequence
  Description of Artificial Sequence: Synthetic polypeptide
DIQMTQSPSSLSASVGDRVTITCRASQGISNWLAWYQQKPGKAPKLLIYGASSLQSGVPSRFSGSGSGTDFTLTISSLQPEDFATYYCQQYSSFPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7656 - protein, 217 aa, Artificial Sequence
  Description of Artificial Sequence: Synthetic polypeptide
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 7657 - protein, 220 aa, Artificial Sequence
  Description of Artificial Sequence: Synthetic polypeptide
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7658 - protein, 214 aa, Artificial Sequence
  Description of Artificial Sequence: Synthetic polypeptide
DIQMTQSPPSLSASAGDRVTITCRASQGISSRLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7659 - protein, 239 aa, Artificial Sequence
  Description of Artificial Sequence: Synthetic polypeptide
MDTRAPTQLLGLLLLWLPGATFAQVLTQTPASVSAAVGGTVTISCQSSESVYKNNYLSWFQQKPGQPPKLLIYEASKLASGVSTRFKGSGSGTQFTLTISGVQCDDAATYYCLGEFSCYSGDCGTFGGGTAVVVKGDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 7660 - protein, 237 aa, Artificial Sequence
  Description of Artificial Sequence: Synthetic polypeptide
MDTRVPTQLLGLLLLWLPGATFAQVLTQTPSPVSAAVGGTVTINCQASKSVYNNVQLSWFQQKPGQPPKRLIYYASTLASGVPSRFKGSGSGTQFTLTISDVQCDDVATYYCAGGYSSSSDNAFGGGTEVVVKGDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 7661 - protein, 214 aa, Artificial Sequence
  Description of Artificial Sequence: Synthetic polypeptide
DIQLTQSPTTVAASPGEKITITCSASSSISSNYLHWYQQKPGFSPKLLIYRTSNLASGVPARFSGSGSGTSYSLTIGTMEAEDVATYYCQQGSNIPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNKNE

SEQ ID NO: 7662 - protein, 213 aa, Artificial Sequence
  Description of Artificial Sequence: Synthetic polypeptide
DIQLTQSPSSLSASLGDKVTITCKASQDINNYIAWYQHKPGKRSRLLIHYTSTLQPGIPSRFSGSGSGRDYSFSISNLEPEDIATYYCLQYDNLLRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNKNE

SEQ ID NO: 7663 - protein, 214 aa, Artificial Sequence
  Description of Artificial Sequence: Synthetic polypeptide
EIVLTQSPDFQSVTPKEKVTFTCRTSQSIGTNIHWYQQKPDQSPKLLIKEVSESISGVPSRFSGSGSGTDFTLTINSLEAEDAATYYCQQSNTWPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7664 - protein, 109 aa, Artificial Sequence
  Description of Artificial Sequence: Synthetic polypeptide
DIVMTQSHKFMSTSVGDRVSITCKASQDVNTAVAWYQQKPGHSPKLLIYSASFRYTGVPDRFTGNRSGTDFTFTISSVQAADLAVYYCQQHYTTPPTFGGGTKLEIKRA

SEQ ID NO: 7665 - protein, 109 aa, Artificial Sequence
  Description of Artificial Sequence: Synthetic polypeptide
DIQMTQSPSSLSASVGDRVTITCRASQVVNTAVAWYQQKPGKAPKLLIYSASFLYSGVPSRFSGSRSGTDFTLTISSLQPEDFATYYCQQHYTTPPTFGQGTKVEIKRT

SEQ ID NO: 7666 - protein, 214 aa, Artificial Sequence; identical to SEQ ID NO: 7663
  Description of Artificial Sequence: Synthetic polypeptide

SEQ ID NO: 7667 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7668 - protein, 218 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7669 - protein, 217 aa, Artificial Sequence
  Description of Artificial Sequence: Synthetic polypeptide
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7670 - protein, 213 aa, Artificial Sequence
  Description of Artificial Sequence: Synthetic polypeptide
DIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7671 - protein, 113 aa, Artificial Sequence
  Description of Artificial Sequence: Synthetic polypeptide
DVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELK

SEQ ID NO: 7672 - protein, 219 aa, Artificial Sequence
  Description of Artificial Sequence: Synthetic polypeptide
DVVMTQSPLSLPVTPGEPASISCRSSQSLVHSNRNTYLHWYLQKPGQSPQLLIYKVSNRFSGVPDRFSGSGSGTDFTLKISRVEAEDVGVYYCSQNTHVPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7673 - protein, 215 aa, Artificial Sequence
  Description of Artificial Sequence: Synthetic polypeptide
EIVMTQSPATLSVSPGERATLSCRASQSVDNNLVWYQQKPGQAPRLLIYGASTRATGIPARFSGSGSGTEFTLTISSLQSEDFAVYYCQQYNNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7674 - protein, 214 aa, Artificial Sequence
  Description of Artificial Sequence: Synthetic polypeptide
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7675 - protein, 220 aa, Artificial Sequence
  Description of Artificial Sequence: Synthetic polypeptide
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7676 - protein, 217 aa, Artificial Sequence
  Description of Artificial Sequence: Synthetic polypeptide
AYDMTQTPASVEIAVGGTVTIRCQASEDIESYLAWYQQKPGQPPKLLIYRASDLASGVSSRFKGSGSGTDYTLTISGVECDDAATYYCQQGYTIDNVDNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7677 - protein, 218 aa, Artificial Sequence
  Description of Artificial Sequence: Synthetic polypeptide
ADIVMTQNPASVSEPVGGTVTIKCQASQSVNSWLSWYQQKPGQPPKFLIYKASTLASGVSSRFKGSGIGTEFTLTISDLECADAATYYCQFSNSGTIYGSGFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7678 - protein, 217 aa, Artificial Sequence
  Description of Artificial Sequence: Synthetic polypeptide
DIQMTQSPSTLSASVGDRVTITCQASQSISSWLAWYQQKPGKAPKLLIYEASKLASGVPSRFSGSGSGTEFTLTISSLQPDDFATYYCQQAYSVANVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7679 - protein, 217 aa, Artificial Sequence
  Description of Artificial Sequence: Synthetic polypeptide
AYDMTQSPASVEAAVGGTVTIRCQASEDIESYLAWYQQKPGQPPKLLIYRASDLASGVSSRFKGSGSGTDYTLTISGLEPEDAATYYCQQGYTIDNVDNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7680 - protein, 217 aa, Artificial Sequence
  Description of Artificial Sequence: Synthetic polypeptide
AYDMTQTPASMEVAVGGTVTIKCQASQSISTYLAWYQQKPGQPPKLLIYDASDLASGVSSRFKGSGSGTQFTLTISGVECDDAATYYCQQDWSDSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7681 - protein, 217 aa, Artificial Sequence
  Description of Artificial Sequence: Synthetic polypeptide
AYDMTQTPASVEVAVGGTVTIKCQASQSISSWLAWYQQKPGQPPKLLIYQASKLASGVPSRFKGSGSGTEFTLTISGVECADAATYYCQQAYSVSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7682 - protein, 222 aa, Artificial Sequence
  Description of Artificial Sequence: Synthetic polypeptide
ADIVMTQTPSSVEAAVGGTVTIKCQASENIYRLLAWYQQKPGQRPKLLIYSASTLASGVPSRFKGSGSGTQFTLTISDLECADAATYYCQNYYYSSRSSYDTYNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7683 - protein, 217 aa, Artificial Sequence
  Description of Artificial Sequence: Synthetic polypeptide
AYDMTQTPASVEVAVGGTVTIKCQASQSISSWLAWYQQKPGQPPKLLIYEASKLASGVPSRFSGSGSGTQFTLTISGVECADAATYYCQQAYSVANVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7684 - protein, 217 aa, Artificial Sequence; identical to SEQ ID NO: 7678
  Description of Artificial Sequence: Synthetic polypeptide

SEQ ID NO: 7685 - protein, 215 aa, Artificial Sequence
  Description of Artificial Sequence: Synthetic polypeptide
QVLTQTPPSVSAVVGGTVTINCQSSQRIYSNWLSWYQQKPGQTPKPLIYAASSLASGVPSRFKGSGSGTQFTLTISDLECDDAASYYCAGYYSGHIYSFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7686 - protein, 216 aa, Artificial Sequence
  Description of Artificial Sequence: Synthetic polypeptide
DIQMTQSPSSVSASVGDRVTITCQSSQRIYSNWLSWYQQKPGKAPKLLIYAASSLASGVPSRFSGSGSGTDFTLTISSLQPEDFATYYCAGYYSGHIYSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7687 - protein, 219 aa, Artificial Sequence
  Description of Artificial Sequence: Synthetic polypeptide
AVLTQTPSPVSAAVGGTVTIKCQSSQSVYNNNLLSWYQQKPGQPPKLLIWGASYLPSGVPDRFSGSGSGTQFTLTISGVQCDDAATYYCLGGYDGDADTYNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7688 - protein, 217 aa, Artificial Sequence
  Description of Artificial Sequence: Synthetic polypeptide
AYDMTQTPASVEVAVGGTVTIKCQVSQSISSWLSWYQKKPGQRPKLLIYRASTLASGVSSRFKGSGSGTEFTLTISGVECADAATYYCQQAYSVSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7689 - protein, 217 aa, Artificial Sequence
  Description of Artificial Sequence: Synthetic polypeptide
DYQMTQSPSTLSASVGDRVTITCQVSQSISSWLSWYQQKPGKAPKLLIYRASTLASGVPSRFSGSGSGTEFTLTISSLQPDDFATYYCQQAYSVSNVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7690 - protein, 217 aa, Artificial Sequence
  Description of Artificial Sequence: Synthetic polypeptide
AYDMTQTPASVEVAVGGTVTIKCQASESIESYLAWYQQKSGQPPKLLIYRASTLASGVSSRFKGSGSGTQFTLTISGVECADAATYYCQQGDAWSNVDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7691 - protein, 217 aa, Artificial Sequence
  Description of Artificial Sequence: Synthetic polypeptide
AYDMTQTPASVEVAVGGTVTIKCQASESISSYLAWYQQKSGQPPKLLIYRASTLASGVSSRFKGSGSGTQFTLTISGVECADAATYYCQQGDAWSNVDNVFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7692 - protein, 217 aa, Artificial Sequence
  Description of Artificial Sequence: Synthetic polypeptide
DIQMTQSPSTLSASVGDRVTITCQASQSISSWLAWYQQKPGKAPKLLIYQASKLASGVPSRFSGSGSGTEFTLTISSLQPDDFATYYCQQAYSVSNVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7693 - protein, 219 aa, Artificial Sequence
  Description of Artificial Sequence: Synthetic polypeptide
QVLTQTPSPVSAAVGGTVTINCQGSQSLYNNNAFSWYQQKPGQPPKLLIYDASTLASGVPSRFKGSGSGTQFTLTISGVQCADAATYYCQGEFSCGDVDCIAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7694 - protein, 219 aa, Artificial Sequence
  Description of Artificial Sequence: Synthetic polypeptide
QVLTQTPSPVSAAVGGTVTINCQASQSFYNNGAFSWYQQKPGQPPKLLIYDASTLASGVPSRFKGSGSGTQFTLTISGVQCGDAATYYCQGEFSCGSADCVAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7695 - protein, 217 aa, Artificial Sequence
  Description of Artificial Sequence: Synthetic polypeptide
AYDMTQTPASVEVAVGGTVTIKCQASQSISTALAWYQQKPGQRPKLLIYDASKLASGVSSRFKGSGSGAQFTLTISGVECADAATYYCHQGYSSSNVDNTFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7696 - protein, 217 aa, Artificial Sequence
  Description of Artificial Sequence: Synthetic polypeptide
DVVMTQTPASVSEPVGGTVTIKCQASQSIDNYLAWYQQKPGQRPRLLIYYTSTLASGVPSRFKGSGSGTEYTLTISDLECADAATYYCQFTAYYSTYIGAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7697 - protein, 217 aa, Artificial Sequence
  Description of Artificial Sequence: Synthetic polypeptide
DIQMTQSPSSLSASVGDRVTITCQASQSIDNYLAWYQQKPGKVPKLLIYYTSTLASGVPSRFSGSGSGTDFTLTISSLQPEDVATYYCQFTAYYSTYIGAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7698 - protein, 217 aa, Artificial Sequence
  Description of Artificial Sequence: Synthetic polypeptide
AYDMTQTPASVEVAVGGTVTIKCQASESISSYLNWYQQKLGQPPKLLIYRASTLTSGVSSRFKGSGSGTEYTLTISDLECADAATYYCQQTYGYSDTDNSFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7699 - protein, 217 aa, Artificial Sequence
  Description of Artificial Sequence: Synthetic polypeptide
AYDMTQTPASVEVAVGGTVTIKCQASESISTYLAWYQQKPGQPPKLLIYRASTLASGVSSRFKGSGSGTQFTLTISGVECADAATYYCQQGYSYSNVDNAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7700 - protein, 217 aa, Artificial Sequence
  Description of Artificial Sequence: Synthetic polypeptide
DIQMTQSPSSLSASVGDRVTITCQASESISTYLAWYQQKPGKVPKLLIYRASTLASGVPSRFSGSGSGTDFTLTISSLQPEDVATYYCQQGYSYSNVDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7701 - protein, 216 aa, Artificial Sequence
  Description of Artificial Sequence: Synthetic polypeptide
QVLTQTASSVSAAVGGTVTISCQSSQSVTNNNDLAWYQQKPGQPPKLLIYQASKLASGVPSRFKGSGSGTQFTLTISDLECDDAATYYCQGSYSGGICAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7702 - protein, 216 aa, Artificial Sequence
  Description of Artificial Sequence: Synthetic polypeptide
ADVVMTQTPASVSEPVGGTVTIKCQASQSISSYLSWYQQKPGQPPKLLIYGASKLTSGVPSRFKGSGSGTEYTLTISDLECADAATYYCQSNYDIYSYAFGGGTEVVVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7703 - protein, 214 aa, Artificial Sequence
  Description of Artificial Sequence: Synthetic polypeptide
DIVMTQSPDSLAMSLGERVTLNCKASENVVSYVSWYQQKPGQSPKLLIYGASNRESGVPDRFSGSGSATDFTLTISSVQAEDVADYHCGQSYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7704 - protein, 215 aa, Artificial Sequence
  Description of Artificial Sequence: Synthetic polypeptide
EIVMTQSPATLSVSPGERATLSCRASQSVDSNLAWYRQKPGQAPRLLIYGASTRATGIPARFSGSGSGTEFTLTISSLQSEDFAVYYCQQYINWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7705 - protein, 219 aa, Artificial Sequence
  Description of Artificial Sequence: Synthetic polypeptide
DIVMTQSPLSLPVTPGEPASISCRSSQSLLHSNGNTYLHWYLQKPGQSPQLLIYTVSNRFSGVPDRFSGSGSGTDFTLKISRVEAEDVGVYYCSQSTHVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7706 - protein, 215 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7707 - protein, 214 aa, Artificial Sequence
  Description of Artificial Sequence: Synthetic polypeptide
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7708 - protein, 214 aa, Artificial Sequence
  Description of Artificial Sequence: Synthetic polypeptide
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7709 - protein, 219 aa, Artificial Sequence
  Description of Artificial Sequence: Synthetic polypeptide
DIVMTQSPLSLPVTPGQPASISCRSSQSIVHSNGNTWLQWWLQKPGQSPQLLIWKVSNRLWGVPDRFSGSGSGTDFTLKISRVQAQDVGVWWCFQGSHVPWTFGQGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7710 - protein, 219 aa, Artificial Sequence
  Description of Artificial Sequence: Synthetic polypeptide
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7711 - protein, 231 aa, Artificial Sequence
  Description of Artificial Sequence: Synthetic polypeptide
MAWIPLFLGVLVYCTGSVASYELTQPPSVSVAPGQTASITCSGDKLGDNFTCWYQQKPGQSPVLVIFQDWKRRPGIPARFSGSKSGNTATLTISGTQAMDEADYYCQAWDISTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7712 - protein, 130 aa, Artificial Sequence
  Description of Artificial Sequence: Synthetic polypeptide
MDMRVPAQLLGLLLLWLPGARCAIQLTQSPSSLSASVGDRVTITCRASQGISSALAWYQQKPGKAPKLLIYDASNLESGVPSRFSGSGSGTDFTLTISSLQPEDFATYYCQQFNSYPTFGQGTKVEIKRT

SEQ ID NO: 7713 - protein, 235 aa, Artificial Sequence
  Description of Artificial Sequence: Synthetic polypeptide
MDMRVPAQLLGLLLLWLPGARCAIQLTQSPSSLSASVGDRVTITCRASQGISSALAWYQQKPGKAPKLLIYDASNLESGVPSRFSGSGSGTDFTLTISSLQPEDFATYYCQQFNSYPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7714 - protein, 130 aa, Artificial Sequence
  Description of Artificial Sequence: Synthetic polypeptide
METPAQLLFLLLLWLPDTTGEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIKRT

SEQ ID NO: 7715 - protein, 219 aa, Artificial Sequence
  Description of Artificial Sequence: Synthetic polypeptide
DIQMTQSPSSLSASVGDRVTITCRSSQSLVHNNANTYLHWYQQKPGKAPKLLIYKVSNRFSGVPSRFSGSGSGTDFTLTISSLQPEDFATYYCSQNTLVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7716 - protein, 112 aa, Artificial Sequence
  Description of Artificial Sequence: Synthetic polypeptide
DVQMTQSPSSLSASVGDRVTITCRSSQSLVHSNGNTYLHWYQQKPGKAPKLLIYKVSNRFSGVPSRFSGSGSGTDFTLTISSLQPEDFATYYCSQSTHVPTFGQGTKVEIKR

SEQ ID NO: 7717 - protein, 206 aa, Artificial Sequence
  Description of Artificial Sequence: Synthetic polypeptide
SLRLSCAVSGFSLTTYGVHWVRQAPGKGLEWVAVIWSDGYTTYNSALKSRFTISRDNSKNTVYLQMNSLRAEDTAVYYCARNDGDYFYSMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7718 - protein, 214 aa, Artificial Sequence
  Description of Artificial Sequence: Synthetic polypeptide
DIQMTQSPSSLSASVGDRVTITCQASQDIGISLSWYQQKPGKAPKLLIYNANNLADGVPSRFSGSGSGTDFTLTISSLQPEDFATYYCLQHNSAPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7719 - protein, 217 aa, Artificial Sequence
  Description of Artificial Sequence: Synthetic polypeptide
QSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7720 - protein, 218 aa, Artificial Sequence
  Description of Artificial Sequence: Synthetic polypeptide
DIVMTQSPDSLSVSLGERATINCRASKSVDSYGNSFMHWYQQKPGQPPKLLIYLASNLESGVPDRFSGSGSGTDFTLTISSLQAEDVAVYYCQQNNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7721 - protein, 218 aa, Artificial Sequence
  Description of Artificial Sequence: Synthetic polypeptide
DIQMTQSPSSLSASVGDRVTITCKASESVDNYGKSLMHWYQQKPGKAPKLLIYRASNLESGVPSRFSGSGSGTDFTLTISSLQPEDFATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7722 - protein, 216 aa, Artificial Sequence
  Description of Artificial Sequence: Synthetic polypeptide
EIVLTQSPATLSLSPGERAILSCRAGQSVSSYLVWYQQKPGQAPRLLIYDASNRATGIPARFSGSGSGTDFTLTISSLEPEDFAVYYCQQRSSWPPVYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7723 - protein, 214 aa, Artificial Sequence
  Description of Artificial Sequence: Synthetic polypeptide
SYVLTQPPSVSVAPGKTARITCGGNIIGSKLVHWYQQKPGQAPVLVIYDDGDRPSGIPERFSGSNSGNTATLTISRVEAGDEADYYCQVWDTGSDPVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7724 - protein, 219 aa, Artificial Sequence
  Description of Artificial Sequence: Synthetic polypeptide
DIVMTQTPLSLSVTPGQPASISCRSSRSLVHSRGNTYLHWYLQKPGQSPQLLIYKVSNRFIGVPDRFSGSGSGTDFTLKISRVEAEDVGVYYCSQSTHLPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7725 - protein, 215 aa, Artificial Sequence
  Description of Artificial Sequence: Synthetic polypeptide
DIQMTQSPSSLSASVGDRVTITCRASQDINSYLSWFQQKPGKAPKSLIVRANRLVDGVPSRFSGSGSGQDYSLTISSLQPEDFATYYCLQYDAFPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7726 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7727 - protein, 234 aa, Artificial Sequence
  Description of Artificial Sequence: Synthetic polypeptide
MEAPAQLLFLLLLWLPDTTGEIVMTQSPATLSVSPGERATLSCRASQSVSSNLAWFQQKPGQAPRPLIYDASTRATGVPARFSGSGSGTDFTLTISSLQSEDFAVYYCQQYDNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7728 - protein, 214 aa, Artificial Sequence
  Description of Artificial Sequence: Synthetic polypeptide
DIQMTQSTSSLSASVGDRVTITCRASQDISNYLSWYQQKPGKAVKLLIYYTSKLHSGVPSRFSGSGSGTDYTLTISSLQQEDFATYFCLQGKMLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7729 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWMFPFGQGTKLEIK

SEQ ID NO: 7730 - protein, 217 aa, Artificial Sequence
  Description of Artificial Sequence: Synthetic polypeptide
QAVLTQPPSVSGAPGQRVTISCTGSSSNIGAGYGVHWYQQLPGTAPKLLIYGDSNRPSGVPDRFSGSKSGTSASLAITGLQAEDEADYYCQSYDNSLSGYVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7731 - protein, 214 aa, Artificial Sequence
  Description of Artificial Sequence: Synthetic polypeptide
DIQMTQSPSSLSASVGDRVTITCRTSENIYSYLAWYQQKPGKAPKLLIYNAKTLAEGVPSRFSGSGSGTDFTLTISSLQPEDFATYYCQHHYGIPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7732 - protein, 214 aa, Artificial Sequence
  Description of Artificial Sequence: Synthetic polypeptide
DIQMTQSPSSLSASVGDRVTITCQASEDIYSFVAWYQQKPGKAPKLLIYNAQTEAQGVPSRFSGSGSGTDFTLTISSLQPEDFATYYCQHHYDSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7733 - protein, 219 aa, Artificial Sequence
  Description of Artificial Sequence: Synthetic polypeptide
DIVMTQSPLSLPVTPGEPASISCRSSQSLLYSIGYNYLDWYLQKSGQSPQLLIYLGSNRASGVPDRFSGSGSGTDFTLKISRVEAEDVGFYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7734 - protein, 107 aa, Artificial Sequence [sequence omitted]

SEQ ID NO: 7735 - protein, 214 aa, Artificial Sequence
  Description of Artificial Sequence: Synthetic polypeptide
DIQMTQSPSSLSASVGDRVTITCGTSEDIINYLNWYQQKPGKAPKLLIYHTSRLQSGVPSRFSGSGSGTDFTLTISSLQPEDFATYYCQQGYTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7736 - protein, 214 aa, Artificial Sequence; identical to SEQ ID NO: 7718
  Description of Artificial Sequence: Synthetic polypeptide

SEQ ID NO: 7737 - protein, 213 aa, Artificial Sequence
  Description of Artificial Sequence: Synthetic polypeptide
QIVLIQSPAIMSASPGEKVTMTCSASSSVSYMYWYQQKPGSSPRLLIYDTSNLASGVPVRFSGSGSGTSYSLTISRMEAEDAATYYCQQWSGYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7738 - protein, 164 aa, Artificial Sequence
  Description of Artificial Sequence: Synthetic polypeptide
MDTRAPTQLLGLLLLWLPGARCAYDMTQTPASVSAAVGGTVTIKCQASQSINNELSWYQQKSGQRPKLLIYRASTLASGVSSRFKGSGSGTEFTLTISDLECADAATYYCQQGYSLRNIDNAFGGGTEVVVKRTVAAPSVFIFPPSDEQLKSGTASVVCLLNNF

SEQ ID NO: 7739 - protein, 100 aa, Artificial Sequence
  Description of Artificial Sequence: Synthetic polypeptide
DIQMTQSPSTLSASVGDRVTITCQASQSINNELSWYQQKPGKAPKLLIYRASTLASGVPSRFSGSGSGTEFTLTISSLQPDDFATYYCQQGYSLRNIDNA

SEQ ID NO: 7740 - protein, 123 aa, Artificial Sequence
  Description of Artificial Sequence: Synthetic polypeptide
MDTRAPTQLLGLLLLWLPGATFAAVLTQTPSPVSAAVGGTVTISCQSSQSVGNNQDLSWFQQRPGQPPKLLIYEISKLESGVPSRFSGSGSGTHFTLTISGVQCDDAATYYCLGGYDDDADNA

SEQ ID NO: 7741 - protein, 123 aa, Artificial Sequence
  Description of Artificial Sequence: Synthetic polypeptide
MDTRAPTQLLGLLLLWLPGATFAAVLTQTPSSVSAAVGGTVSISCQSSQSVYSNKYLAWYQQKPGQPPKLLIYWTSKLASGAPSRFSGSGSGTQFTLTISGVQCDDAATYYCLGAYDDDADNA

SEQ ID NO: 7742 - protein, 123 aa, Artificial Sequence
  Description of Artificial Sequence: Synthetic polypeptide
MDTRAPTQLLGLLLLWLPGATFAAVLTQTPSPVSAAVGGTVTISCQSSQSVYNNNDLAWYQQKPGQPPKLLIYYASTLASGVPSRFKGSGSGTQFTLTISGVQCDDAAAYYCLGGYDDDADNA

SEQ ID NO: 7743 - protein, 123 aa, Artificial Sequence
  Description of Artificial Sequence: Synthetic polypeptide
MDTRAPTQLLGLLLLWLPGATFAAVLTQTPSSVSAAVGGTVTINCQSSQSVYNNDYLSWYQQRPGQRPKLLIYGASKLASGVPSRFKGSGSGKQFTLTISGVQCDDAATYYCLGDYDDDADNT

SEQ ID NO: 7744 - protein, 119 aa, Artificial Sequence
  Description of Artificial Sequence: Synthetic polypeptide
MDTRAPTQLLGLLLLWLPGARCDVVMTQTPASVEAAVGGTVTIKCQASETIGNALAWYQQKSGQPPKLLIYKASKLASGVPSRFKGSGSGTEYTLTISDLECADAATYYCQWCYFGDSV

SEQ ID NO: 7745 - protein, 163 aa, Artificial Sequence
  Description of Artificial Sequence: Synthetic polypeptide
MDTRAPTQLLGLLLLWLPGARCAYDMTQTPASVSAAVGGTVTIKCQASQSINNELSWYQQKPGQRPKLLIYRASTLASGVSSRFKGSGSGTEFTLTISDLECADAATYYCQQGYSLRNIDNAFGGGTEVVVKRTVAAPSVFIFPPSDEQLKSGTASVVCLLNN

SEQ ID NO: 7746 - protein, 99 aa, Artificial Sequence
  Description of Artificial Sequence: Synthetic polypeptide
IQMTQSPSSLSASVGDRVTITCQASQSINNELSWYQQKPGKAPKLLIYRASTLASGVPSRFSGSGSGTDFTLTISSLQPDDFATYYCQQGYSLRNIDNA

SEQ ID NO: 7747 - protein, 119 aa, Artificial Sequence
  Description of Artificial Sequence: Synthetic polypeptide
MDTRAPTQLLGLLLLWLPGARCDVVMTQTPASVEAAVGGTVTIKCQASESIGNALAWYQQKPGQPPKLLIYKASTLASGVPSRFSGSGSGTEFTLTISGVQCADAAAYYCQWCYFGDSV

SEQ ID NO: 7748 - protein, 170 aa, Artificial Sequence
  Description of Artificial Sequence: Synthetic polypeptide
MDTRAPTQLLGLLLLWLPGARCAYDMTQTPASVEVAVGGTVTINCQASETIYSWLSWYQQKPGQPPKLLIYQASDLASGVPSRFSGSGAGTEYTLTISGVQCDDAATYYCQQGYSGSNVDNVFGGGTEVVVKRTVAAPSVFIFPPSDEQLKSGTASVVCLLNNFYPREAK

SEQ ID NO: 7749 - protein, 123 aa, Artificial Sequence
  Description of Artificial Sequence: Synthetic polypeptide
MDTRAPTQLLGLLLLWLPGARCDVVMTQTPASVEAAVGGTVTIKCQASQSVSSYLNWYQQKPGQPPKLLIYRASTLESGVPSRFKGSGSGTEFTLTISDLECADAATYYCQCTYGTSSSYGAA

SEQ ID NO: 7750 - protein, 125 aa, Artificial Sequence
  Description of Artificial Sequence: Synthetic polypeptide
MDTRAPTQLLGLLLLWLPGATFAQVLTQTASPVSAAVGGTVTINCQASQSVYKNNYLSWYQQKPGQPPKGLIYSASTLDSGVPLRFSGSGSGTQFTLTISDVQCDDAATYYCLGSYDCSSGDCYA

SEQ ID NO: 7751 - protein, 123 aa, Artificial Sequence
  Description of Artificial Sequence: Synthetic polypeptide
MDTRAPTQLLGLLLLWLPGSTFAAVLTQTPSPVSAAVGGTVSISCQASQSVYDNNYLSWYQQKPGQPPKLLIYGASTLASGVPSRFKGTGSGTQFTLTITDVQCDDAATYYCAGVFNDDSDDA

SEQ ID NO: 7752 - protein, 123 aa, Artificial Sequence
  Description of Artificial Sequence: Synthetic polypeptide
MDTRAPTQLLGLLLLWLPGATFAAVLTQTPSPVSAAVGGTVTISCQASQSVYNNKNLAWYQQKSGQPPKLLIYWASTLASGVSSRFSGSGSGTQFTLTVSGVQCDDAATYYCLGVFDDDADNA

SEQ ID NO: 7753 - protein, 120 aa, Artificial Sequence
  Description of Artificial Sequence: Synthetic polypeptide
MDTRAPTQLLGLLLLWLPGARCAFELTQTPASVEAAVGGTVTINCQASQNIYRYLAWYQQKPGQPPKFLIYLASTLASGVPSRFKGSGSGTEFTLTISDLECADAATYYCQSYYSSNSVA

SEQ ID NO: 7754 - protein, 122 aa, Artificial Sequence
  Description of Artificial Sequence: Synthetic polypeptide
MDTRAPTQLLGLLLLWLPGARCAYDMTQTPASVEVAVGGTVTIKCQASEDIYRLLAWYQQKPGQPPKLLIYDSSDLASGVPSRFKGSGSGTEFTLAISGVQCDDAATYYCQQAWSYSDIDNA

SEQ ID NO: 7755 - protein, 123 aa, Artificial Sequence
  Description of Artificial Sequence: Synthetic polypeptide
MDTRAPTQLLGLLLLWLPGATFAAVLTQTASPVSAAVGATVTINCQSSQSVYNDMDLAWFQQKPGQPPKLLIYSASTLASGVPSRFSGSGSGTEFTLTISGVQCDDAATYYCLGAFDDDADNT

SEQ ID NO: 7756 - protein, 121 aa, Artificial Sequence
  Description of Artificial Sequence: Synthetic polypeptide
MDTRAPTQLLGLLLLWLPGARCAYDMTQTPASVEVAVGGTVTIKCQASQSVYNWLSWYQQKPGQPPKLLIYTASSLASGVPSRFSGSGSGTEFTLTISGVECADAATYYCQQGYTSDVDNV

SEQ ID NO: 7757 - protein, 123 aa, Artificial Sequence
  Description of Artificial Sequence: Synthetic polypeptide
MDTRAPTQLLGLLLLWLPGAKCADVVMTQTPASVSAAVGGTVTINCQASENIYNWLAWYQQKPGQPPKLLIYTVGDLASGVSSRFKGSGSGTEFTLTISDLECADAATYYCQQGYSSSYVDNV

SEQ ID NO: 7758 - protein, 121 aa, Artificial Sequence
  Description of Artificial Sequence: Synthetic polypeptide
MDTRAPTQLLGLLLLWLPGATFAQVLTQTPSSVSAAVGGTVTINCQASQSVYQNNYLSWFQQKPGQPPKLLIYGAATLASGVPSRFKGSGSGTQFTLTISDLECDDAATYYCAGAYRDVDS

SEQ ID NO: 7759 - protein, 165 aa, Artificial Sequence
  Description of Artificial Sequence: Synthetic polypeptide
MDTRAPTQLLGLLLLWLPGATFAAVLTQTPSPVSAAVGGTVSISCQASQSVYDNNYLSWFQQKPGQPPKLLIYGASTLASGVPSRFVGSGSGTQFTLTITDVQCDDAATYYCAGVYDDDSDNAFGGGTEVVVKRTVAAPSVFIFPPSDEQLKSGTASVVCLLNNF

SEQ ID NO: 7760 - protein, 120 aa, Artificial Sequence
  Description of Artificial Sequence: Synthetic polypeptide
MDTRAPTQLLGLLLLWLPGARCAFELTQTPSSVEAAVGGTVTIKCQASQSISSYLAWYQQKPGQPPKFLIYRASTLASGVPSRFKGSGSGTEFTLTISDLECADAATYYCQSYYDSVSNP

SEQ ID NO: 7761 - protein, 124 aa, Artificial Sequence
  Description of Artificial Sequence: Synthetic polypeptide
MDTRAPTQLLGLLLLWLPGVTFAIEMTQSPFSVSAAVGGTVSISCQASQSVYKNNQLSWYQQKSGQPPKLLIYGASALASGVPSRFKGSGSGTEFTLTISDVQCDDAATYYCAGAITGSIDTDG

SEQ ID NO: 7762 - protein, 124 aa, Artificial Sequence
  Description of Artificial Sequence: Synthetic polypeptide
MDTRAPTQLLGLLLLWLPGARCDVVMTQTPASVEAAVGGTVTIKCQASEDISSYLAWYQQKPGQPPKLLIYAASNLESGVSSRFKGSGSGTEYTLTISDLECADAATYYCQCTYGTISISDGNA

SEQ ID NO: 7763 - protein, 124 aa, Artificial Sequence
  Description of Artificial Sequence: Synthetic polypeptide
MDTRAPTQLLGLLLLWLPGARCDVVMTQTPASVSAAVGGTVTIKCQASEDIESYLAWYQQKPGQPPKLLIYGASNLESGVSSRFKGSGSGTEFTLTISDLECADAATYYCQCTYGIISISDGNA

SEQ ID NO: 7764 - protein, 124 aa, Artificial Sequence
  Description of Artificial Sequence: Synthetic polypeptide
MDTRAPTQLLGLLLLWLPGATFAAVLTQTPSPVSEPVGGTVSISCQSSKSVMNNNYLAWYQQKPGQPPKLLIYGASNLASGVPSRFSGSGSGTQFTLTISDVQCDDAATYYCQGGYTGYSDHGT

SEQ ID NO: 7765 - protein, 121 aa, Artificial Sequence
  Description of Artificial Sequence: Synthetic polypeptide
MDTRAPTQLLGLLLLWLPGATFAAVLTQTPSPVSAAVGGTVSISCQSSQSVYNNNWLSWFQQKPGQPPKLLIYKASTLASGVPSRFKGSGSGTQFTLTISDVQCDDVATYYCAGGYLDSVI

SEQ ID NO: 7766 - protein, 122 aa, Artificial Sequence
  Description of Artificial Sequence: Synthetic polypeptide
MDTRAPTQLLGLLLLWLPGARCASDMTQTPSSVSAAVGGTVTINCQASENIYSFLAWYQQKPGQPPKLLIFKASTLASGVSSRFKGSGSGTQFTLTISDLECDDAATYYCQQGATVYDIDNN

SEQ ID NO: 7767 - protein, 122 aa, Artificial Sequence
  Description of Artificial Sequence: Synthetic polypeptide
MDTRAPTQLLGLLLLWLPGARCASDMTQTPSSVSAAVGGTVTINCQASENIYSFLAWYQQKPGQPPKLLIFRASTLASGVSSRFKGSGSGTQFTLTISDLECDDAATYYCQQGATVYDIDNN

SEQ ID NO: 7768 - protein, 124 aa, Artificial Sequence
  Description of Artificial Sequence: Synthetic polypeptide
MDTRAPTQLLGLLLLWLPGATFAIEMTQTPSPVSAAVGGTVTINCQASESVFNNMLSWYQQKPGHSPKLLIYDASDLASGVPSRFKGSGSGTQFTLTISGVECDDAATYYCAGYKSDSNDGDNV

SEQ ID NO: 7769 - protein, 121 aa, Artificial Sequence
  Description of Artificial Sequence: Synthetic polypeptide
MDTRAPTQLLGLLLLWLPGATFAQVLTQTASSVSAAVGGTVTINCQSSQSVYNNYLSWYQQKPGQPPKLLIYTASSLASGVPSRFKGSGSGTQFTLTISEVQCDDAATYYCQGYYSGPIIT

SEQ ID NO: 7770 - protein, 164 aa, Artificial Sequence
  Description of Artificial Sequence: Synthetic polypeptide
MDTRAPTQLLGLLLLWLPGAICDPVLTQTPSPVSAPVGGTVSISCQASQSVYENNYLSWFQQKPGQPPKLLIYGASTLDSGVPSRFKGSGSGTQFTLTITDVQCDDAATYYCAGVYDDDSDDAFGGGTEVVVKRTVAAPSVFIFPPSDEQLKSGTASVVCLLNN

SEQ ID NO: 7771 - protein, 122 aa, Artificial Sequence
  Description of Artificial Sequence: Synthetic polypeptide
MDTRAPTQLLGLLLLWLPGATFAQVLTQTPSPVSVPVGDTVTISCQSSESVYSNNLLSWYQQKPGQPPKLLIYRASNLASGVPSRFKGSGSGTQFTLTISGAQCDDAATYYCQGYYSGVINS

SEQ ID NO: 7772 - protein, 122 aa, Artificial Sequence
  Description of Artificial Sequence: Synthetic polypeptide
MDTRAPTQLLGLLLLWLPGARCAYDMTQTPASVEVAVGGTVTIKCQATESIGNELSWYQQKPGQAPKLLIYSASTLASGVPSRFKGSGSGTQFTLTITGVECDDAATYYCQQGYSSANIDNA

SEQ ID NO: 7773 - protein, 122 aa, Artificial Sequence; identical to SEQ ID NO: 7772
  Description of Artificial Sequence: Synthetic polypeptide

SEQ ID NO: 7774 - protein, 111 aa, Artificial Sequence
  Description of Artificial Sequence: Synthetic polypeptide
AYDMTQTPASVSAAVGGTVTIKCQASQSINNELSWYQQKPGQRPKLLIYRASTLASGVSSRFKGSGSGTEFTLTISDLECADAATYYCQQGYSLRNIDNAFGGGTEVVVKR

SEQ ID NO: 7775 - protein, 88 aa, Artificial Sequence
  Description of Artificial Sequence: Synthetic polypeptide
AIQMTQSPSSLSASVGDRVTITCRASQGIRNDLGWYQQKPGKAPKLLIYAASSLQSGVPSRFSGSGSGTDFTLTISSLQPEDFATYYC

SEQ ID NO: 7776 - protein, 88 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYC

SEQ ID NO: 7777 - protein, 88 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYC

SEQ ID NO: 7778 - protein, 111 aa, Artificial Sequence
  Description of Artificial Sequence: Synthetic polypeptide
AIQMTQSPSSLSASVGDRVTITCQASQSINNELSWYQQKPGKAPKLLIYRASTLASGVPSRFSGSGSGTDFTLTISSLQPEDFATYYCQQGYSLRNIDNAFGGGTKVEIKR

SEQ ID NO: 7779 - protein, 122 aa, Artificial Sequence
  Description of Artificial Sequence: Synthetic polypeptide
MDTRAPTQLLGLLLLWLPGARCAYDMTQTPASVSAAVGGTVTIKCQASQSINNELSWYQQKPGQRPKLLIYRASTLASGVSSRFKGSGSGTEFTLTISDLECADAATYYCQQGYSLRNIDNA

SEQ ID NO: 7780 - protein, 216 aa, Artificial Sequence
  Description of Artificial Sequence: Synthetic polypeptide
IQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7781 - protein, 122 aa, Artificial Sequence
  Description of Artificial Sequence: Synthetic polypeptide
MDTRAPTQLLGLLLLWLPGARCAYDMTQTPASVEVAVGGTVTINCQASETIYSWLSWYQQKPGQPPKLLIYQASDLASGVPSRFSGSGAGTEYTLTISGVQCDDAATYYCQQGYSGSNVDNV

SEQ ID NO: 7782 - protein, 123 aa, Artificial Sequence
  Description of Artificial Sequence: Synthetic polypeptide
MDTRAPTQLLGLLLLWLPGATFAAVLTQTPSPVSAAVGGTVSISCQASQSVYDNNYLSWFQQKPGQPPKLLIYGASTLASGVPSRFVGSGSGTQFTLTITDVQCDDAATYYCAGVYDDDSDNA

SEQ ID NO: 7783 - protein, 123 aa, Artificial Sequence
  Description of Artificial Sequence: Synthetic polypeptide
MDTRAPTQLLGLLLLWLPGAICDPVLTQTPSPVSAPVGGTVSISCQASQSVYENNYLSWFQQKPGQPPKLLIYGASTLDSGVPSRFKGSGSGTQFTLTITDVQCDDAATYYCAGVYDDDSDDA

SEQ ID NO: 7784 - protein, 122 aa, Artificial Sequence
  Description of Artificial Sequence: Synthetic polypeptide
MDTRAPTQLLGLLLLWLPGATFAQVLTQTPSPVSAAVGGTVTINCQASQSVDDNNWLGWYQQKRGQPPKYLIYSASTLASGVPSRFKGSGSGTQFTLTISDLECDDAATYYCAGGFSGNIFA

SEQ ID NO: 7785 - protein, 122 aa, Artificial Sequence
  Description of Artificial Sequence: Synthetic polypeptide
MDTRAPTQLLGLLLLWLPGATFAAVLTQTPSPVSVPVGGTVTIKCQSSQSVYNNFLSWYQQKPGQPPKLLIYQASKLASGVPDRFSGSGSGTQFTLTISGVQCDDAATYYCLGGYDDDADNA

SEQ ID NO: 7786 - protein, 122 aa, Artificial Sequence
  Description of Artificial Sequence: Synthetic polypeptide
MDTRAPTQLLGLLLLWLPGARCAYDMTQTPASVSAAVGGTVTIKCQASQSINNELSWYQQKSGQRPKLLIYRASTLASGVSSRFKGSGSGTEFTLTISDLECADAATYYCQQGYSLRNIDNA

SEQ ID NO: 7787 - protein, 164 aa, Artificial Sequence
  Description of Artificial Sequence: Synthetic polypeptide
MDTRAPTQLLGLLLLWLPGATFAQVLTQTPSPVSAAVGGTVTINCQASQSVDDNNWLGWYQQKRGQPPKYLIYSASTLASGVPSRFKGSGSGTQFTLTISDLECDDAATYYCAGGFSGNIFAFGGGTEVVVKRTVAAPSVFIFPPSDEQLKSGTASVVCLLNNF

SEQ ID NO: 7788 - protein, 217 aa, Artificial Sequence
  Description of Artificial Sequence: Synthetic polypeptide
DIQMTQSPSTLSASVGDRVTITCQASQSINNELSWYQQKPGKAPKLLIYRASTLASGVPSRFSGSGSGTEFTLTISSLQPDDFATYYCQQGYSLRNIDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7789 - protein, 112 aa, Artificial Sequence
  Description of Artificial Sequence: Synthetic polypeptide
AIQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKRT

SEQ ID NO: 7790 - protein, 217 aa, Artificial Sequence
  Description of Artificial Sequence: Synthetic polypeptide
AIQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7791 - protein, 235 aa, Artificial Sequence
  Description of Artificial Sequence: Synthetic polypeptide
MKWVTFISLLFLFSSAYSAIQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7792 - protein, 111 aa, Artificial Sequence
  Description of Artificial Sequence: Synthetic polypeptide
AIQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKR

SEQ ID NO: 7793 - protein, 164 aa, Artificial Sequence
  Description of Artificial Sequence: Synthetic polypeptide
MDTRAPTQLLGLLLLWLPGATFAAVLTQTPSPVSVPVGGTVTIKCQSSQSVYNNFLSWYQQKPGQPPKLLIYQASKLASGVPDRFSGSGSGTQFTLTISGVQCDDAATYYCLGGYDDDADNAFGGGTEVVVKRTVAAPSVFIFPPSDEQLKSGTASVVCLLNNF

SEQ ID NO: 7794 - protein, 214 aa, Artificial Sequence
  Description of Artificial Sequence: Synthetic polypeptide
DIQMTQSPSSVSASVGDRVTITCRASQGISSWLAWYQQKPGKAPKLLIYGASSLESGVPSRFSGSGSGTDFTLTISSLQPEDFASYYCQQANSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7795 - protein, 64 aa, Artificial Sequence
  Description of Artificial Sequence: Synthetic polypeptide
DIQMTQSPASLSASLEEIVTITCQASQDIGISLSWYQQKPGRTPQLLIQNANNLADGVPSRFSG

SEQ ID NO: 7796 - protein, 111 aa, Artificial Sequence
  Description of Artificial Sequence: Synthetic polypeptide
NFMLTQPHSVSGSPGKTVTISCTRSSGSIDSSYVQWYQQRPGNSPTTVIYEDDQRPSGVPDRFSGSIDSSSNSASLTISGLVTEDEADYYCQSYDSSHLVFGGGTKLTVLC

SEQ ID NO: 7797 - protein, 111 aa, Artificial Sequence
  Description of Artificial Sequence: Synthetic polypeptide
NFMLTQPHSVSGSPGKTVTISCTRSSGSIDSSYVQWYQQRPGNSPTTVIYEDDQRPSGVPDRFSGSIDSSSNSASLTISGLVTEDEADYYCMQYDFHHLVFGGGTKLTVLC

SEQ ID NO: 7798 - protein, 216 aa, Artificial Sequence
  Description of Artificial Sequence: Synthetic polypeptide
NFMLTQPHSVSGSPGKTVTISCTRSSGSIDSSYVQWYQQRPGNSPTTVIYEDDQRPSGVPDRFSGSIDSSSNSASLTISGLVTEDEADYYCQSYDFHHLVFGGGTKLTVLTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7799 - protein, 112 aa, Artificial Sequence
  Description of Artificial Sequence: Synthetic polypeptide
NFMLTQPHSVSESPGKTVTISCTGSSGRIASSYVQWYQQRPGSAPTTVIYEDNQRPSGVPDRFSGSIDSSSNSASLTISGLKTEDEADYYCQSYASSSLWVFGGGTQLTVLS

SEQ ID NO: 7800 - protein, 110 aa, Artificial Sequence
  Description of Artificial Sequence: Synthetic polypeptide
NFMLTQPHSVSESPGKTVTISCTRSSGSIDSSYVQWYQQRPGSSPTTVIYEDDQRPSGVPDRFSGSIDSSSNSASLTISGLKTEDEADYYCQSYDFHHLVFGGGTKLTVL

SEQ ID NO: 7801 - protein, 215 aa, Artificial Sequence
  Description of Artificial Sequence: Synthetic polypeptide
NFMLTQPHSVSESPGKTVTISCTRSSGSIDSSYVQWYQQRPGSSPTTVIYEDDQRPSGVPDRFSGSIDSSSNSASLTISGLKTEDEADYYCQSYDFHHLVFGGGTKLTVLQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7802 - protein, 110 aa, Artificial Sequence
  Description of Artificial Sequence: Synthetic polypeptide
NFMLTQPHSVSESPGKTVTISCTRSSGSIDSSYVQWYQQRPGSSPTTVIYEDDQRPSGVPDRFSGSIDSSSNSASLTISGLKTEDEADYYCMQYDFHHLVFGGGTKLTVL

SEQ ID NO: 7803 - protein, 111 aa, Artificial Sequence
  Description of Artificial Sequence: Synthetic polypeptide
NFMLTQPHSVSGSPGKTVTISCTRSSGSIDSSYVQWYQQRPGNSPTTVIYEDDQRPSGVPDRFSGSIDSSSNSASLTISGLVTEDEADYYCMQYDSSHLVFGGGTKLTVLC

SEQ ID NO: 7804 - protein, 111 aa, Artificial Sequence
  Description of Artificial Sequence: Synthetic polypeptide
NFMLTQPHSVSGSPGKTVTISCTRSSGSIDSSYVQWYQQRPGNSPTTVIYEDDQRPSGVPDRFSGSIDSSSNSASLTISGLVTEDEADYYCQSYDFHHLVFGGGTKLTVLC

SEQ ID NO: 7805 - protein, 111 aa, Artificial Sequence; identical to SEQ ID NO: 7804
  Description of Artificial Sequence: Synthetic polypeptide

SEQ ID NO: 7806 - protein, 215 aa, Artificial Sequence
  Description of Artificial Sequence: Synthetic polypeptide
DIQMTQSPSSLSASVGDRVTITCKASQHVITHVTWYQQKPGKAPKLLIYGSTSYSYSGVPSRFSGSGSGTDFTLTISSLQPEDFATYYCQQFYEYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7807 - protein, 108 aa, Artificial Sequence
  Description of Artificial Sequence: Synthetic polypeptide
DIQMTQSPSSLSASVGDRVTITCQASQDIGISLSWYQQKPGKAPKLLIYNANNLADGVPSRFSGSGSGTDFTLTISSLQPEDFATYYTFGQGTKLEIKRCLQHNSAPY

SEQ ID NO: 7808 - protein, 214 aa, Artificial Sequence
  Description of Artificial Sequence: Synthetic polypeptide
DIQMTQSPSSVSASVGDRVTITCRASQGISSWLAWYQQKPGKAPKLLIYGASNLESGVPSRFSGSGSGTDFTLTISSLQPEDFANYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7809 - protein, 214 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7810 - protein, 213 aa, Artificial Sequence
  Description of Artificial Sequence: Synthetic polypeptide
DFVMTQSPAFLSVTPGEKVTITCSAQSSVNYIHWYQQKPDQAPKKLIYDTSKLASGVPSRFSGSGSGTDYTFTISSLEAEDAATYYCQQWTTNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7811 - protein, 214 aa, Artificial Sequence
  Description of Artificial Sequence: Synthetic polypeptide
EIVLTQSPATLSLSPGERATLSCQASQSISNFLHWYQQRPGQAPRLLIRYRSQSISGIPARFSGSGSGTDFTLTISSLEPEDFAVYYCQQSGSWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7812 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7813 - protein, 214 aa, Artificial Sequence
  Description of Artificial Sequence: Synthetic polypeptide
DIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7814 - protein, 214 aa, Artificial Sequence
  Description of Artificial Sequence: Synthetic polypeptide
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7815 - protein, 214 aa, Artificial Sequence
  Description of Artificial Sequence: Synthetic polypeptide
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7816 - protein, 214 aa, Artificial Sequence
  Description of Artificial Sequence: Synthetic polypeptide
DIQMTQTTSSLSASLGDRVTISCSSSQDISNYLNWYQQKPDGTVKVLIYYTSTLHLGVPSRFSGSGSGTDYSLTISNLELEDIATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7817 - protein, 214 aa, Artificial Sequence
  Description of Artificial Sequence: Synthetic polypeptide
DIQMTQSPSSLSASVGDRVTITCSSSQDISNYLNWYQQKPGKAPKLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7818 - protein, 214 aa, Artificial Sequence
  Description of Artificial Sequence: Synthetic polypeptide
DIQMTQSPSSLSASVGDRVTITCSSSQDISNYLNWYQQKPGKAPKLLIYYTSTLHLGIPPRFSGSGYGTDFTLTINNIESEDAAYYFCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7819 - protein, 214 aa, Artificial Sequence
  Description of Artificial Sequence: Synthetic polypeptide
EIVLTQSPATLPVTLGQPASISCSSSQDISNYLNWYQQKPGQAPRLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7820 - protein, 214 aa, Artificial Sequence
  Description of Artificial Sequence: Synthetic polypeptide
DIQMTQSPSSLSASVGDRVTITCSSSQDISNYLNWYLQKPGQSPQLLIYYTSTLHLGIPDRFSGSGSGTDFTLTISRLEPEDFAVYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7821 - protein, 214 aa, Artificial Sequence
  Description of Artificial Sequence: Synthetic polypeptide
EIVLTQSPATLSLSPGERATLSCSSSQDISNYLNWYQQKPGKAPKLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7822 - protein, 214 aa, Artificial Sequence
  Description of Artificial Sequence: Synthetic polypeptide
DIVMTQTPLSLPVTPGEPASISCSSSQDISNYLNWYQQKPGQAPRLLIYYTSTLHLGVPSRFSGSGSGTEFTLTISSLQPDDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7823 - protein, 214 aa, Artificial Sequence
  Description of Artificial Sequence: Synthetic polypeptide
DIQMTQSPSSLSASVGDRVTITCSSSQDISNYLNWYLQKPGQSPQLLIYYTSTLHLGVPSRFSGSGSGTEFTLTISSLQPDDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7824 - protein, 214 aa, Artificial Sequence
  Description of Artificial Sequence: Synthetic polypeptide
EIVLTQSPDFQSVTPKEKVTITCSSSQDISNYLNWYQQKPGQAPRLLIYYTSTLHLGVPSRFSGSGSGTDFTLTISSLQPEDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7825 - protein, 214 aa, Artificial Sequence
  Description of Artificial Sequence: Synthetic polypeptide
DIQMTQSPSSLSASVGDRVTITCSSSQDISNYLNWYQQKPGKAPKLLIYYTSTLHLGVPSRFSGSGSGTDFTFTISSLQPEDIATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7826 - protein, 214 aa, Artificial Sequence
  Description of Artificial Sequence: Synthetic polypeptide
AIQLTQSPSSLSASVGDRVTITCSSSQDISNYLNWYQQKPGQAPRLLIYYTSTLHLGVPSRFSGSGSGTDFTLTISSLQPEDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7827 - protein, 214 aa, Artificial Sequence
  Description of Artificial Sequence: Synthetic polypeptide
EIVLTQSPDFQSVTPKEKVTITCSSSQDISNYLNWYQQKPGQAPRLLIYYTSTLHLGVPSRFSGSGSGTDFTFTISSLEAEDAATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7828 - protein, 214 aa, Artificial Sequence
  Description of Artificial Sequence: Synthetic polypeptide
DIVMTQTPLSLPVTPGEPASISCSSSQDISNYLNWYQQKPGQAPRLLIYYTSTLHLGIPDRFSGSGSGTDFTLTISRLEPEDFAVYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7829 - protein, 215 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7830 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7831 - protein, 219 aa, Artificial Sequence
  Description of Artificial Sequence: Synthetic polypeptide
DIVMTQTPLSLSVTPGQPASISCRSSKSLLHSNGNTYLYWFLQKPGQSPQFLIYRMSNLASGVPDRFSGSGSGTDFTLKISRVEAEDVGVYYCMQHLEYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7832 - protein, 214 aa, Artificial Sequence
  Description of Artificial Sequence: Synthetic polypeptide
DIQLTQSPSSLSASVGDRVTITCRASENIYSNLAWYRQKPGKAPKLLVFAASNLADGVPSRFSGSGSGTDYTFTISSLQPEDIATYYCQHFWTTPWAFGGGTKLQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7833 - protein, 214 aa, Artificial Sequence
  Description of Artificial Sequence: Synthetic polypeptide
DIQMTQTTSSLSASLGDRVTISCRASQDISKYLNWYQQQPDGTIKLLIYYTSRLHSGVPSRFSGRGSGTDYSLTISNVEQEDIATYFCQQGSTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7834 - protein, 214 aa, Artificial Sequence
  Description of Artificial Sequence: Synthetic polypeptide
DIQMTQTTSSLSASLGDRVTISCRASQDINKYLNWYQQQPDGTVKLLIYYTSRLHSGVPSRFSGRGSGTDYSLTISNLEQEDIATYFCQQGSTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7835 - protein, 214 aa, Artificial Sequence
  Description of Artificial Sequence: Synthetic polypeptide
DIQMTQTTSSLSASLGDRVTFSCRASQDISKYLNWYQQQPDGTIKLLIYYTSRLHSGVPSRFSGRGSGTDYSLTITNLEQEDIATYFCQQGSALPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7836 - protein, 214 aa, Artificial Sequence
  Description of Artificial Sequence: Synthetic polypeptide
DIQMTQTTSSLSASLGDRVTISCRASQDISKYLNWYQQQPDGTVKLLIYYTSRLHSGVPSRFSGRGSGTDYSLTISNLEQEDIATYFCQQGSTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7837 - protein, 214 aa, Artificial Sequence
  Description of Artificial Sequence: Synthetic polypeptide
DIQMTQTTSSLSASLGDRVTISCRASQDISKYLNWYQQQPDGTIKLLIYYTSRLHSGVPSRFSGRGSGTDYSLTITNLEQEDIATYFCQQGSALPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7838 - protein, 213 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7839 - protein, 215 aa, Artificial Sequence
  Description of Artificial Sequence: Synthetic polypeptide
DIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7840 - protein, 220 aa, Artificial Sequence
  Description of Artificial Sequence: Synthetic polypeptide
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7841 - protein, 217 aa, Artificial Sequence
  Description of Artificial Sequence: Synthetic polypeptide
LEIVLTQSPATLSLSPGERATLSCRASQSVSSYLAWYQQKPGQAPRLLIYDASNRATGIPARFSGSGSGTDFTLTISSLEPEDFAVYYCQQRSNWPPSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 7842 - protein, 216 aa, Artificial Sequence
  Description of Artificial Sequence: Synthetic polypeptide
LETTLTQSPGTLSLSPGERATLSCRASQSIINSHLAWYQQKPGQAPRLLIYGASSRATGIPDRFSGGGSGTDFTLTITRLETEDFALYFCQQYGTSPLTFGGGTRVETKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7843 - protein, 215 aa, Artificial Sequence
  Description of Artificial Sequence: Synthetic polypeptide
LDIQLTQSPSSVSASVGDRVTITCRASQVISSWLAWYQQKPGKAPKLLISTASSLQSGVPPRFSGSGSGTDFTLTITSLQPEDFATYYCQQANSFPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7844 - protein, 220 aa, Artificial Sequence
  Description of Artificial Sequence: Synthetic polypeptide
LEIVMTQSPLSLPVTPGEPASISCRSSQSLLHSNGNNYLDWYLQKPGQSPQLLIYLGSNRASGVPDRFSGSGSGTDFTLKITRVEAEDVGVYYCMQALQTPLTFGGGTKMEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7845 - protein, 220 aa, Artificial Sequence
  Description of Artificial Sequence: Synthetic polypeptide
LDVVMTQSPLSLPVTPGEPASISCRSSQSLLHSDGNNYLDWYLQKPGQSPQLLIYLGSNRASGVPDRFSGSGSGTDFTLKISRVEPEDVGVYYCMQALHIPLTFGQGTRLEIKRTVAAPSVFIFPPSDEQLKSGTASVVCLLNNFYPREAKVQWKVDNALQSGNSQESVTEQDSRDSTYSLSSTLTLSKADYEKHKVYACEVTHQGLSSPVTKSFNRGEC

SEQ ID NO: 7846 - protein, 214 aa, Artificial Sequence
  Description of Artificial Sequence: Synthetic polypeptide
DIQMTQSPSSLSASVGDRVTITCRSSQRIMTYLNWYQQKPGKAPKLLIFVASHSQSGVPSRFRGSGSETDFTLTISGLQPEDSATYYCQQSFWTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7847 - protein, 115 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTV

SEQ ID NO: 7848 - protein, 219 aa, Artificial Sequence; identical to SEQ ID NO: 7528
  Description of Artificial Sequence: Synthetic polypeptide

SEQ ID NO: 7849 - protein, 213 aa, Artificial Sequence
  Description of Artificial Sequence: Synthetic polypeptide
DIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7850 - protein, 218 aa, Artificial Sequence
  Description of Artificial Sequence: Synthetic polypeptide
IVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7851 - protein, 213 aa, Artificial Sequence; identical to SEQ ID NO: 7554
  Description of Artificial Sequence: Synthetic polypeptide

SEQ ID NO: 7852 - protein, 213 aa, Artificial Sequence
  Description of Artificial Sequence: Synthetic polypeptide
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7853 - protein, 217 aa, Artificial Sequence
  Description of Artificial Sequence: Synthetic polypeptide
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 7854 - protein, 214 aa, Artificial Sequence
  Description of Artificial Sequence: Synthetic polypeptide
EIVLTQSPATLSLSPGERATLSCRASQSVSRYLAWYQQKPGQAPRLLIYDASNRATGIPARFSGSGSGTDFTLTISSLEPEDFAVYYCQQRSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7855 - protein, 219 aa, Artificial Sequence
  Description of Artificial Sequence: Synthetic polypeptide
DIVMTQSPLSVPVTPGEPVSISCRSSKSLLHSNGNTYLYWFLQRPGQSPQLLIYRMSNLVSGVPDRFSGSGSGTAFTLRISRVEAEDVGVYYCLQHLEYPFTFGPGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7856 - protein, 215 aa, Artificial Sequence
  Description of Artificial Sequence: Synthetic polypeptide
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7857 - protein, 213 aa, Artificial Sequence
  Description of Artificial Sequence: Synthetic polypeptide
QVVLTQSPVIMSASPGEKVTMTCSASSSISYMYWYQQKPGTSPKRWIYDTSKLASGVPARFSGSGSGTSYSLTISNMEAGDAATYYCHQRDSYPWTFGGGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7858 - protein, 219 aa, Artificial Sequence; identical to SEQ ID NO: 7855
  Description of Artificial Sequence: Synthetic polypeptide

SEQ ID NO: 7859 - protein, 219 aa, Artificial Sequence
  Description of Artificial Sequence: Synthetic polypeptide
DVVMTQSPLSLPVTLGQPASISCRSSQIIIHSDGNTYLEWFQQRPGQSPRRLIYKVSNRFSGVPDRFSGSGSGTDFTLKISRVEAEDVGVYYCFQGSHVPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7860 - protein, 214 aa, Artificial Sequence
  Description of Artificial Sequence: Synthetic polypeptide
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7861 - protein, 215 aa, Artificial Sequence
  Description of Artificial Sequence: Synthetic polypeptide
DIVLTQSPATLSLSPGERATLSCRASQSVRSNYLAWYQQKPGQAPRLLIYGASSRATGVPARFSGSGSGTDFTLTISSLEPEDFAVYYCQQYSNFPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7862 - protein, 215 aa, Artificial Sequence
  Description of Artificial Sequence: Synthetic polypeptide
QAVVTQEPSLTVSPGGTVTLTCRSSTGAVTTSNYANWFQQKPGQAPRTLIGGTNNRAPGVPARFSGSLLGGKAALTLSGAQPEDEAEYYCALWYSNHWVFGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 7863 - protein, 214 aa, Artificial Sequence
  Description of Artificial Sequence: Synthetic polypeptide
DIQMTQSPSSLSASVGDRVTITCRASQYFSSYLAWYQQKPGKAPKLLIYGASSRASGVPSRFSGSGSGTDFTLTISSLQPEDFATYYCQQYLGSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7864 - protein, 214 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7865 - protein, 220 aa, Artificial Sequence
  Description of Artificial Sequence: Synthetic polypeptide
DIVMTQSPSSLTVTAGEKVTMSCKSSQSLLDSGNQKNFLTWYQQKPGQPPKLLIFWASTRESGVPDRFTGSGSVTDFTLTISSVQAEDLAVYYCQNDYSYPCTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7866 - protein, 220 aa, Artificial Sequence
  Description of Artificial Sequence: Synthetic polypeptide
DIVMTQSPSSLTVTAGEKVTMSCKSSQSLLDSGNQKNFLTWYQQKPGQPPKLLIFWASTRESGVPDRFTGSGSVTDFTLTISSVQAEDLAVYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7867 - protein, 220 aa, Artificial Sequence
  Description of Artificial Sequence: Synthetic polypeptide
EIVLTQSPATLSLSPGERATLSCKSSQSLLDSGNQKNFLTWYQQKPGQAPRLLIYWASTRESGVPSRFSGSGSGTEFTLTISSLQPDDFATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7868 - protein, 220 aa, Artificial Sequence
  Description of Artificial Sequence: Synthetic polypeptide
DIQMTQSPSSLSASVGDRVTITCKSSQSLLDSGNQKNFLTWYQQKPGQAPRLLIYWASTRESGIPPRFSGSGYGTDFTLTINNIESEDAAYYFCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7869 - protein, 220 aa, Artificial Sequence
  Description of Artificial Sequence: Synthetic polypeptide
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7870 - protein, 220 aa, Artificial Sequence
  Description of Artificial Sequence: Synthetic polypeptide
DIVMTQTPLSLPVTPGEPASISCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7871 - protein, 220 aa, Artificial Sequence
  Description of Artificial Sequence: Synthetic polypeptide
EIVLTQSPATLSLSPGERATLSCKSSQSLLDSGNQKNFLTWYQQKPGKAPKLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7872 - protein, 220 aa, Artificial Sequence
  Description of Artificial Sequence: Synthetic polypeptide
EIVLTQSPDFQSVTPKEKVTITCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7873 - protein, 220 aa, Artificial Sequence
  Description of Artificial Sequence: Synthetic polypeptide
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7874 - protein, 220 aa, Artificial Sequence
  Description of Artificial Sequence: Synthetic polypeptide
DIQMTQSPSSLSASVGDRVTITCKSSQSLLDSGNQKNFLTWYLQKPGQSPQLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7875 - protein, 220 aa, Artificial Sequence
  Description of Artificial Sequence: Synthetic polypeptide
DVVMTQSPLSLPVTLGQPASISCKSSQSLLDSGNQKNFLTWYQQKPGKAPKLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7876 - protein, 218 aa, Artificial Sequence
  Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7877 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7878 - protein, 215 aa, Artificial Sequence
  Description of Artificial Sequence: Synthetic polypeptide
DIQMTQSPSSLSASVGDRVSITCRPSQSFSRYINWYQQKPGKAPKLLIHAASSLVGGVPSRFSGSGSGTDFTLTISSLQPEDFATYYCQQTYSNPPITFGQGTRLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7879 - protein, 215 aa, Artificial Sequence
  Description of Artificial Sequence: Synthetic polypeptide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7880 - protein, 108 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 7881 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7882 - protein, 214 aa, Artificial Sequence; identical to SEQ ID NO: 7384
  Description of Artificial Sequence: Synthetic polypeptide

SEQ ID NO: 7883 - protein, 108 aa, Artificial Sequence; identical to SEQ ID NO: 7880
  Description of Artificial Sequence: Synthetic polypeptide

SEQ ID NO: 7884 - protein, 214 aa, Artificial Sequence
  Description of Artificial Sequence: Synthetic polypeptide
DIQMTQSPSSLSASLGERVSLTCRASQDIGSSLNWLQQGPDGTIKRLIYATSSLDSGVPKRFSGSRSGSDYSLTISSLESEDFVDYYCLQYVSSPPTFGAGTKLELKRADAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7885 - protein, 214 aa, Artificial Sequence
  Description of Artificial Sequence: Synthetic polypeptide
DIQMTQSPSSVSASVGDRVTITCRASQGISGWLAWYQQKPGKAPKFLIYAASTLQSGVPSRFSGSGSGTDFTLTISSLQPEDFATYYCQQANSFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7886 - protein, 214 aa, Artificial Sequence
  Description of Artificial Sequence: Synthetic polypeptide
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7887 - protein, 215 aa, Artificial Sequence
  Description of Artificial Sequence: Synthetic polypeptide
QIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7888 - protein, 220 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPQIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELK

SEQ ID NO: 7889 - protein, 221 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPQIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELK

SEQ ID NO: 7890 - protein, 226 aa, Artificial Sequence
  Description of Artificial Sequence: Synthetic polypeptide
DVVMTQSPLSLPVTLGQPASISCRSSQIIIHSDGNTYLEWFQQRPGQSPRRLIYKVSNRFSGVPDRFSGSGSGTDFTLKISRVEAEDVGVYYCFQGSHVPHTFGQGTKVEIKRTVAAPQIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELK

SEQ ID NO: 7891 - protein, 214 aa, Artificial Sequence
  Description of Artificial Sequence: Synthetic polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7892 - protein, 219 aa, Artificial Sequence
  Description of Artificial Sequence: Synthetic polypeptide
DIQMTQSPSSLSASVGDRVTITCRSSETLVHSSGNTYLEWYQQKPGKAPKLLIYRVSNRFSGVPSRFSGSGSGTDFTLTISSLQPEDFATYYCFQGSFNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7893 - protein, 220 aa, Artificial Sequence
  Description of Artificial Sequence: Synthetic polypeptide
DIQMTQSPSSLSASVGDRVTITCKSSQSLLYRSNQKNYLAWYQQKPGKAPKLLIYWASTRESGVPSRFSGSGSGTDFTLTISSLQPEDFATYYCQQYYNYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7894 - protein, 239 aa, Artificial Sequence
  Description of Artificial Sequence: Synthetic polypeptide
MDTRAPTQLLGLLLLWLPGARCAYQMTQSPSSLSASVGDRVTIKCQASESIYSSLAWYQQKPGKPPKLLIYSASTLASGVPSRFSGSGSGTDFTLTISSLQPEDFATYYCQQGFGTSNVENPFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7895 - protein, 239 aa, Artificial Sequence
  Description of Artificial Sequence: Synthetic polypeptide
MDMRVPAQLLGLLLLWLRGARCDIQMTQSPSSLSASVGDRVTIKCQASESIYSSLAWYQQKPGKPPKLLIYSASTLASGVPSRFSGSGSGTDFTLTISSLQPEDFATYYCQQGFGTSNVENPFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7896 - protein, 212 aa, Artificial Sequence
  Description of Artificial Sequence: Synthetic polypeptide
DIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 7897 - protein, 213 aa, Artificial Sequence
  Description of Artificial Sequence: Synthetic polypeptide
SELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 7898 - protein, 215 aa, Artificial Sequence
  Description of Artificial Sequence: Synthetic polypeptide
EIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7899 - protein, 213 aa, Artificial Sequence
  Description of Artificial Sequence: Synthetic polypeptide
DIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7900 - protein, 218 aa, Artificial Sequence
  Description of Artificial Sequence: Synthetic polypeptide
DIQMTQSPSSLSASVGDRVTITCRASQSVSTSSYSYMHWYQQKPGKAPKLLIKYASNLESGVPSRFSGSGSGTDFTLTISSLQPEDFATYYCQHSWEIPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7901 - protein, 218 aa, Artificial Sequence
  Description of Artificial Sequence: Synthetic polypeptide
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7902 - protein, 216 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7903 - protein, 214 aa, Artificial Sequence
  Description of Artificial Sequence: Synthetic polypeptide
EIVLTQSPATLSLSPGERATLSCRASQSVSRYLAWYQQKPGQAPRLLIYDASNRATGIPARFSGSGSGTDSTLTISSLEPEDFAVYYCQQRSNWPRTFGQGTKVEIKRTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 7904 - protein, 214 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7905 - protein, 213 aa, Artificial Sequence
  Description of Artificial Sequence: Synthetic polypeptide
EIVLTQSPATLSLSPGERATLSCSASSSVSYMHWYQQKPGQAPRLLIYTTSNLASGIPARFSGSGSGTDFTLTISSLEPEDFAVYYCHQWSSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7906 - protein, 114 aa, Artificial Sequence
  Description of Artificial Sequence: Synthetic polypeptide
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKRA

SEQ ID NO: 7907 - protein, 214 aa, Artificial Sequence
  Description of Artificial Sequence: Synthetic polypeptide
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7908 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWLMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7909 - protein, 214 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEEDSKDSTYSLSSTLTLSKADYEKHKVYACEVTHQGLSSPVTKSFNRGEC

SEQ ID NO: 7910 - protein, 214 aa, Artificial Sequence
  Description of Artificial Sequence: Synthetic polypeptide
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7911 - protein, 214 aa, Artificial Sequence
  Description of Artificial Sequence: Synthetic polypeptide
DIQMTQSPSSLSASVGDRVTITCRASQDISNYLAWFQQKPGKAPKSLIYAASSLHSKVPTQFSGSGSGTDFTLTISSLQPEDFATYYCLQYSTYPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7912 - protein, 106 aa, Artificial Sequence
  Description of Artificial Sequence: Synthetic polypeptide
DIVMTQSPLSLPVTPGEPASISCRASSSLSFMHWYQQKPGQPPKLLIYATSNLASGIPARFSGSGSGTDFTLTISSLEPEDFAVYYCHQWSSNPLTFGQGTKVEIK

SEQ ID NO: 7913 - protein, 106 aa, Artificial Sequence
  Description of Artificial Sequence: Synthetic polypeptide
DIVMTQSPLSLPVTPGEPASISCRASSSLSFMHWYLQKPGQSPQLLIYATSNLASGIPARFSGSGSGTDFTLTISSLEPEDFAVYYCHQWSSNPLTFGQGTKVEIK

SEQ ID NO: 7914 - protein, 106 aa, Artificial Sequence
  Description of Artificial Sequence: Synthetic polypeptide
DIVMTQSPLSLPVTPGEPASISCRASSSLSFMHWYQQKPGQAPRLLIYATSNLASGVPDRFSGSGSGTDFTLTISSLQAEDVAVYYCHQWSSNPLTFGQGTKVEIK

SEQ ID NO: 7915 - protein, 106 aa, Artificial Sequence
  Description of Artificial Sequence: Synthetic polypeptide
DIVMTQSPLSLPVTPGEPASISCRASSSLSFMHWYQQKPGKAPKLLIYATSNLASGVPDRFSGSGSGTDFTLTISSLQAEDVAVYYCHQWSSNPLTFGQGTKVEIK

SEQ ID NO: 7916 - protein, 106 aa, Artificial Sequence
  Description of Artificial Sequence: Synthetic polypeptide
DIVMTQSPLSLPVTPGEPASISCRASSSLSFMHWYQQKPGQPPKLLIYATSNLASGVPSRFSGSGSGTDFTFTISSLQPEDIATYYCHQWSSNPLTFGQGTKVEIK

SEQ ID NO: 7917 - protein, 106 aa, Artificial Sequence
  Description of Artificial Sequence: Synthetic polypeptide
DIVMTQSPLSLPVTPGEPASISCRASSSLSFMHWYQQKPGQAPRLLIYATSNLASGVPSRFSGSGSGTDFTFTISSLQPEDIATYYCHQWSSNPLTFGQGTKVEIK

SEQ ID NO: 7918 - protein, 106 aa, Artificial Sequence
  Description of Artificial Sequence: Synthetic polypeptide
DIVMTQSPLSLPVTPGEPASISCRASSSLSFMHWYQQKPGQAPRLLIYATSNLASGVPSRFSGSGSGTEFTLTISSLQPDDFATYYCHQWSSNPLTFGQGTKVEIK

SEQ ID NO: 7919 - protein, 106 aa, Artificial Sequence
  Description of Artificial Sequence: Synthetic polypeptide
DIVMTQSPDSLAVSLGERATINCRASSSLSFMHWYQQKPGQAPRLLIYATSNLASGVPSRFSGSGSGTDFTLTISSLQPEDFATYYCHQWSSNPLTFGQGTKVEIK

SEQ ID NO: 7920 - protein, 106 aa, Artificial Sequence
  Description of Artificial Sequence: Synthetic polypeptide
DIVMTQSPDSLAVSLGERATINCRASSSLSFMHWYQQKPGQPPKLLIYATSNLASGIPARFSGSGSGTDFTLTISSLEPEDFAVYYCHQWSSNPLTFGQGTKVEIK

SEQ ID NO: 7921 - protein, 106 aa, Artificial Sequence
  Description of Artificial Sequence: Synthetic polypeptide
DIVMTQSPLSLPVTPGEPASISCRASSSLSFMHWYLQKPGQSPQLLIYATSNLASGVPDRFSGSGSGTDFTLKISRVEAEDVGVYYCHQWSSNPLTFGQGTKVEIK

SEQ ID NO: 7922 - protein, 106 aa, Artificial Sequence
  Description of Artificial Sequence: Synthetic polypeptide
DIQMTQSPSSLSASVGDRVTITCRASSSLSFMHWYLQKPGQSPQLLIYATSNLASGVPDRFSGSGSGTDFTLTISSLQAEDVAVYYCHQWSSNPLTFGQGTKVEIK

SEQ ID NO: 7923 - protein, 106 aa, Artificial Sequence
  Description of Artificial Sequence: Synthetic polypeptide
DIQMTQSPSTLSASVGDRVTITCRASSSLSFMHWYQQKPGQAPRLLIYATSNLASGVPSRFSGSGSGTDFTFTISSLQPEDIATYYCHQWSSNPLTFGQGTKVEIK

SEQ ID NO: 7924 - protein, 106 aa, Artificial Sequence
  Description of Artificial Sequence: Synthetic polypeptide
EIVLTQSPGTLSLSPGERATLSCRASSSLSFMHWYLQKPGQSPQLLIYATSNLASGVPDRFSGSGSGTDFTLTISSLQAEDVAVYYCHQWSSNPLTFGQGTKVEIK

SEQ ID NO: 7925 - protein, 106 aa, Artificial Sequence
  Description of Artificial Sequence: Synthetic polypeptide
DIVMTQSPDSLAVSLGERATINCRASSSLSFMHWYQQKPGKAPKLLIYATSNLASGVPSRFSGSGSGTEFTLTISSLQPDDFATYYCHQWSSNPLTFGQGTKVEIK

SEQ ID NO: 7926 - protein, 106 aa, Artificial Sequence
  Description of Artificial Sequence: Synthetic polypeptide
EIVMTQSPATLSVSPGERATLSCRASSSLSFMHWYLQKPGQSPQLLIYATSNLASGVPSRFSGSGSGTDFTLTISSLQPEDFATYYCHQWSSNPLTFGQGTKVEIK

SEQ ID NO: 7927 - protein, 106 aa, Artificial Sequence
  Description of Artificial Sequence: Synthetic polypeptide
EIVLTQSPGTLSLSPGERATLSCRASSSLSFMHWYQQKPGKAPKLLIYATSNLASGVPSRFSGSGSGTEFTLTISSLQPDDFATYYCHQWSSNPLTFGQGTKVEIK

SEQ ID NO: 7928 - protein, 106 aa, Artificial Sequence
  Description of Artificial Sequence: Synthetic polypeptide
EIVLTQSPATLSLSPGERATLSCRASSSLSFMHWYQQKPGKAPKLLIYATSNLASGVPSRFSGSGSGTEFTLTISSLQPDDFATYYCHQWSSNPLTFGQGTKVEIK

SEQ ID NO: 7929 - protein, 106 aa, Artificial Sequence
  Description of Artificial Sequence: Synthetic polypeptide
EIVLTQSPATLSLSPGERATLSCRASSSLSFMHWYQQKPGQPPKLLIYATSNLASGIPARFSGSGSGTEFTLTISSLQSEDFAVYYCHQWSSNPLTFGQGTKVEIK

SEQ ID NO: 7930 - protein, 106 aa, Artificial Sequence
  Description of Artificial Sequence: Synthetic polypeptide
EIVLTQSPATLSLSPGERATLSCRASSSLSFMHWYQQKPGQPPKLLIYATSNLASGVPSRFSGSGSGTDFTFTISSLQPEDIATYYCHQWSSNPLTFGQGTKVEIK

SEQ ID NO: 7931 - protein, 106 aa, Artificial Sequence
  Description of Artificial Sequence: Synthetic polypeptide
EIVMTQSPATLSVSPGERATLSCRASSSLSFMHWYQQKPGQPPKLLIYATSNLASGVPSRFSGSGSGTDFTFTISSLQPEDIATYYCHQWSSNPLTFGQGTKVEIK

SEQ ID NO: 7932 - protein, 106 aa, Artificial Sequence
  Description of Artificial Sequence: Synthetic polypeptide
EIVLTQSPGTLSLSPGERATLSCRASSSLSFMHWYQQKPGQAPRLLIYATSNLASGVPSRFSGSGSGTDFTFTISSLQPEDIATYYCHQWSSNPLTFGQGTKVEIK

SEQ ID NO: 7933 - protein, 106 aa, Artificial Sequence
  Description of Artificial Sequence: Synthetic polypeptide
EIVLTQSPGTLSLSPGERATLSCRASSSLSFMHWYQQKPGQPPKLLIYATSNLASGVPSRFSGSGSGTDFTLTISSLQPEDFATYYCHQWSSNPLTFGQGTKVEIK

SEQ ID NO: 7934 - protein, 106 aa, Artificial Sequence
  Description of Artificial Sequence: Synthetic polypeptide
EIVLTQSPATLSLSPGERATLSCRASSSLSFMHWYQQKPGQPPKLLIYATSNLASGVPSRFSGSGSGTDFTLTISSLQPEDFATYYCHQWSSNPLTFGQGTKVEIK

SEQ ID NO: 7935 - protein, 106 aa, Artificial Sequence
  Description of Artificial Sequence: Synthetic polypeptide
EIVMTQSPATLSVSPGERATLSCRASSSLSFMHWYQQKPGQPPKLLIYATSNLASGVPSRFSGSGSGTDFTLTISSLQPEDFATYYCHQWSSNPLTFGQGTKVEIK

SEQ ID NO: 7936 - protein, 250 aa, Artificial Sequence
  Description of Artificial Sequence: Synthetic polypeptide
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 7937 - protein, 213 aa, Artificial Sequence
  Description of Artificial Sequence: Synthetic polypeptide
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7938 - protein, 219 aa, Artificial Sequence
  Description of Artificial Sequence: Synthetic polypeptide
DVVMSQSPSSLAVSVGEKVTMSCKSSQSLLYSGNQKNYLAWYQQKPGQSPRLLIYWASTRESGVPDRFTGSGSGTDFTLTISSVKAEDLAVFYCQQYYNYPLTFGGGTHLTVLGQPKASPSVTLFPPSSEELGANKATLVCLISDFYPSGVTVAWKADGSPITQGVETTKPSKQSNNKYAASSYLSLTPDKWKSHSSFSCLVTHEGSTVEKKVAPAECS

SEQ ID NO: 7939 - protein, 214 aa, Artificial Sequence; identical to SEQ ID NO: 7885
  Description of Artificial Sequence: Synthetic polypeptide

SEQ ID NO: 7940 - protein, 215 aa, Artificial Sequence; identical to SEQ ID NO: 7643
  Description of Artificial Sequence: Synthetic polypeptide

SEQ ID NO: 7941 - protein, 214 aa, Artificial Sequence; identical to SEQ ID NO: 7794
  Description of Artificial Sequence: Synthetic polypeptide

SEQ ID NO: 7942 - protein, 210 aa, Artificial Sequence
  Description of Artificial Sequence: Synthetic polypeptide
DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTRLEIKRADAAPTVFIFPPSDEQLKSGTASVVCLLNNFYPREAKVQWKVDNALQSGNSQESVTEQDSKDSTYSLSSTLTLSKADYEKHKVYACEVTHQGLSSPVTKSFN

SEQ ID NO: 7943 - protein, 236 aa, Artificial Sequence
  Description of Artificial Sequence: Synthetic polypeptide
MKKNIAFLLASMFVFSIATNAYAQIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7944 - protein, 232 aa, Artificial Sequence; identical to SEQ ID NO: 7531
  Description of Artificial Sequence: Synthetic polypeptide

SEQ ID NO: 7945 - protein, 213 aa, Artificial Sequence; identical to SEQ ID NO: 7530
  Description of Artificial Sequence: Synthetic polypeptide

SEQ ID NO: 7946 - protein, 213 aa, Artificial Sequence
  Description of Artificial Sequence: Synthetic polypeptide
DIQMTQSPSSLSASVGDRVTITCRASSSVSYLHWYQQKPGKAPKPLIYAPSNLASGVPSRFSGSGSGTDFTLTISSLQPEDFATYYCQQWSFNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7947 - protein, 213 aa, Artificial Sequence
  Description of Artificial Sequence: Synthetic polypeptide
DIQMTQSPSSLSASVGDRVTITCRASSSVSYLHWYQQKPGKAPKPLIYAPSNLASGVPSRFSGSGSGTDFTLTISSLQPEDFATYYCQQWAFNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7948 - protein, 219 aa, Artificial Sequence
  Description of Artificial Sequence: Synthetic polypeptide
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7949 - protein, 214 aa, Artificial Sequence; identical to SEQ ID NO: 7814
  Description of Artificial Sequence: Synthetic polypeptide

SEQ ID NO: 7950 - protein, 107 aa, Artificial Sequence
  Description of Artificial Sequence: Synthetic polypeptide
DILLTQSPGTLSLSPGERATLSCRASQSIGTNIHWYQQKPGQAPRLLIKYASESISGIPSRFSGSGSGTDFTLTISRLEPEDFAMYYCQQSDSWPTTFGQGTKVEIK

SEQ ID NO: 7951 - protein, 214 aa, Artificial Sequence [sequence omitted]

SEQ ID NO: 7952 - protein, 214 aa, Artificial Sequence; identical to SEQ ID NO: 7396
  Description of Artificial Sequence: Synthetic polypeptide

SEQ ID NO: 7953 - protein, 214 aa, Artificial Sequence; identical to SEQ ID NO: 7396
  Description of Artificial Sequence: Synthetic polypeptide

SEQ ID NO: 7954 - protein, 106 aa, Artificial Sequence
  Description of Artificial Sequence: Synthetic polypeptide
QIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELK

SEQ ID NO: 7955 - protein, 211 aa, Artificial Sequence; identical to SEQ ID NO: 7360
  Description of Artificial Sequence: Synthetic polypeptide

SEQ ID NO: 7956 - protein, 213 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 7957 - protein, 213 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRADTAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7958 - protein, 214 aa, Artificial Sequence; identical to SEQ ID NO: 7396
  Description of Artificial Sequence: Synthetic polypeptide

SEQ ID NO: 7959 - protein, 107 aa, Artificial Sequence
  Description of Artificial Sequence: Synthetic polypeptide
DIQMTQSPSTLSASVGDRVTITCRASQSINTWLAWYQQKPGKAPKLLMYKASSLESGVPSRFIGSGSGTEFTLTISSLQPDDFATYYCQQYNSDSKMFGQGTKVEVK

SEQ ID NO: 7960 - protein, 116 aa, Artificial Sequence; identical to SEQ ID NO: 7319
  Description of Artificial Sequence: Synthetic polypeptide

SEQ ID NO: 7961 - protein, 117 aa, Artificial Sequence [sequence omitted]

SEQ ID NO: 7962 - protein, 213 aa, Artificial Sequence; identical to SEQ ID NO: 7530
  Description of Artificial Sequence: Synthetic polypeptide

SEQ ID NO: 7963 - protein, 107 aa, Artificial Sequence
  Description of Artificial Sequence: Synthetic polypeptide
DIVMTQTPSSLSASVGDRVTITCRASQDISKYLNWYQQKPGKAPKLLIYHTSRLHSGVPSRFSGSGSGTDTTLTISSLQPEDFATYYCQQGNTLPYTFGPGTKVDIK

SEQ ID NO: 7964 - protein, 450 aa, Artificial Sequence
  Description of Artificial Sequence: Synthetic polypeptide
QVQLVQSGGGVVQPGRSLRLSCAASGVSLPDYGVSWVRQAPGKGLEWVAVIWGSETTYYNSALKSRFTISRDNSKNTLYLQMNSLRAEDTAVYYCAKHYYYGGSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7965 - protein, 214 aa, Artificial Sequence
  Description of Artificial Sequence: Synthetic polypeptide
DIQMTQSPSSLSASVGDRVTITCRASQDISKYLNWYQQKPGKAIKLLIYHTSRLHSGVPSRFSGSGSGTDFTLTISSLQPEDFATYYCQQGATLPYTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7966 - protein, 10 aa, Artificial Sequence
  Description of Artificial Sequence: Synthetic peptide
SASSSISYMH

SEQ ID NO: 7967 - protein, 7 aa, Artificial Sequence
  Description of Artificial Sequence: Synthetic peptide
TTSNLAS

SEQ ID NO: 7968 - protein, 9 aa, Artificial Sequence
  Description of Artificial Sequence: Synthetic peptide
HQRSTYPLT

SEQ ID NO: 7969 - protein, 128 aa, Artificial Sequence
  Description of Artificial Sequence: Synthetic polypeptide
MSVPTQVLGLLLLWLTDARCDIQMTQSPSSLSASVGDRVTITCLASEGISSYLAWYQQKPGKAPKLLIYGANSLQTGVPSRFSGSGSATDYTLTISSLQPEDFATYYCQQSYKFPNTFGQGTKVEVKR

SEQ ID NO: 7970 - protein, 6 aa, Artificial Sequence
  Description of Artificial Sequence: Synthetic peptide
QDIHGY

SEQ ID NO: 7971 - protein, 16 aa, Artificial Sequence
  Description of Artificial Sequence: Synthetic peptide
RSSQSLANSYGNTFLS

SEQ ID NO: 7972 - protein, 12 aa, Artificial Sequence
  Description of Artificial Sequence: Synthetic peptide
RASQSVGSSYLA

SEQ ID NO: 7973 - protein, 11 aa, Artificial Sequence
  Description of Artificial Sequence: Synthetic peptide
RASQSVSSYLA

SEQ ID NO: 7974 - protein, 11 aa, Artificial Sequence
  Description of Artificial Sequence: Synthetic peptide
RASQSVDSNLA

SEQ ID NO: 7975 - protein, 11 aa, Artificial Sequence
  Description of Artificial Sequence: Synthetic peptide
QGDSLRSYYAT

SEQ ID NO: 7976 - protein, 15 aa, Artificial Sequence
  Description of Artificial Sequence: Synthetic peptide
RASKSVDSYGNSFMH

SEQ ID NO: 7977 - protein, 12 aa, Artificial Sequence
  Description of Artificial Sequence: Synthetic peptide
RASQSVSSSYLA

SEQ ID NO: 7978 - protein, 11 aa, Artificial Sequence
  Description of Artificial Sequence: Synthetic peptide
RASQSVSSNLA

SEQ ID NO: 7979 - protein, 11 aa, Artificial Sequence
  Description of Artificial Sequence: Synthetic peptide
RTSENIYSYLA

SEQ ID NO: 7980 - protein, 11 aa, Artificial Sequence
  Description of Artificial Sequence: Synthetic peptide
QSLLYSIGYNY

SEQ ID NO: 7981 - protein, 17 aa, Artificial Sequence
  Description of Artificial Sequence: Synthetic peptide
KSSQSLLNSGNQKNYLA

SEQ ID NO: 7982 - protein, 10 aa, Artificial Sequence
  Description of Artificial Sequence: Synthetic peptide
SASSSVSYMY

SEQ ID NO: 7983 - protein, 11 aa, Artificial Sequence
  Description of Artificial Sequence: Synthetic peptide
RASQGISSWLA

SEQ ID NO: 7984 - protein, 17 aa, Artificial Sequence
  Description of Artificial Sequence: Synthetic peptide
KSSQSLLYTSSQKNYLA

SEQ ID NO: 7985 - protein, 11 aa, Artificial Sequence
  Description of Artificial Sequence: Synthetic peptide
RASQSVSSYLA

SEQ ID NO: 7986 - protein, 12 aa, Artificial Sequence
  Description of Artificial Sequence: Synthetic peptide
SASSSVSSSYLY

SEQ ID NO: 7987 - protein, 15 aa, Artificial Sequence
  Description of Artificial Sequence: Synthetic peptide
RASKGVSTSGYSYLH

SEQ ID NO: 7988 - protein, 17 aa, Artificial Sequence
  Description of Artificial Sequence: Synthetic peptide
KSSQSLLYSGNQKNYLA

SEQ ID NO: 7989 - protein, 11 aa, Artificial Sequence
  Description of Artificial Sequence: Synthetic peptide
RASQSVSSYLA

SEQ ID NO: 7990 - protein, 11 aa, Artificial Sequence
  Description of Artificial Sequence: Synthetic peptide
GASENIYGALN

SEQ ID NO: 7991 - protein, 10 aa, Artificial Sequence
  Description of Artificial Sequence: Synthetic peptide
SASISVSYMY

SEQ ID NO: 7992 - protein, 11 aa, Artificial Sequence
  Description of Artificial Sequence: Synthetic peptide
RASQSVYSYLA

SEQ ID NO: 7993 - protein, 3 aa, Artificial Sequence
  Description of Artificial Sequence: Synthetic peptide
YTS

SEQ ID NO: 7994 - protein, 7 aa, Artificial Sequence
  Description of Artificial Sequence: Synthetic peptide
GISNRFS

SEQ ID NO: 7995 - protein, 7 aa, Artificial Sequence
  Description of Artificial Sequence: Synthetic peptide
GAFSRAT

SEQ ID NO: 7996 - protein, 7 aa, Artificial Sequence
  Description of Artificial Sequence: Synthetic peptide
DASNRAT

SEQ ID NO: 7997 - protein, 7 aa, Artificial Sequence
  Description of Artificial Sequence: Synthetic peptide
GASTRAT

SEQ ID NO: 7998 - protein, 7 aa, Artificial Sequence
  Description of Artificial Sequence: Synthetic peptide
GENKRPS

SEQ ID NO: 7999 - protein, 7 aa, Artificial Sequence
  Description of Artificial Sequence: Synthetic peptide
LASNLES

SEQ ID NO: 8000 - protein, 7 aa, Artificial Sequence
  Description of Artificial Sequence: Synthetic peptide
GASSRAT

SEQ ID NO: 8001 - protein, 7 aa, Artificial Sequence
  Description of Artificial Sequence: Synthetic peptide
DASTRAT

SEQ ID NO: 8002 - protein, 7 aa, Artificial Sequence
  Description of Artificial Sequence: Synthetic peptide
NAKTLAE

SEQ ID NO: 8003 - protein, 3 aa, Artificial Sequence
  Description of Artificial Sequence: Synthetic peptide
LGS

SEQ ID NO: 8004 - protein, 7 aa, Artificial Sequence
  Description of Artificial Sequence: Synthetic peptide
GASTRES

SEQ ID NO: 8005 - protein, 7 aa, Artificial Sequence
  Description of Artificial Sequence: Synthetic peptide
DTSNLAS

SEQ ID NO: 8006 - protein, 7 aa, Artificial Sequence
  Description of Artificial Sequence: Synthetic peptide
AASSLQS

SEQ ID NO: 8007 - protein, 7 aa, Artificial Sequence
  Description of Artificial Sequence: Synthetic peptide
WASTRES

SEQ ID NO: 8008 - protein, 7 aa, Artificial Sequence
  Description of Artificial Sequence: Synthetic peptide
DASNRAT

SEQ ID NO: 8009 - protein, 7 aa, Artificial Sequence
  Description of Artificial Sequence: Synthetic peptide
STSNLAS

SEQ ID NO: 8010 - protein, 7 aa, Artificial Sequence
  Description of Artificial Sequence: Synthetic peptide
LASYLES

SEQ ID NO: 8011 - protein, 7 aa, Artificial Sequence
  Description of Artificial Sequence: Synthetic peptide
WASARES

SEQ ID NO: 8012 - protein, 7 aa, Artificial Sequence
  Description of Artificial Sequence: Synthetic peptide
DASNRAT

SEQ ID NO: 8013 - protein, 7 aa, Artificial Sequence
  Description of Artificial Sequence: Synthetic peptide
GATNLAD

SEQ ID NO: 8014 - protein, 7 aa, Artificial Sequence
  Description of Artificial Sequence: Synthetic peptide
DMSNLAS

SEQ ID NO: 8015 - protein, 7 aa, Artificial Sequence
  Description of Artificial Sequence: Synthetic peptide
DASNRAT

SEQ ID NO: 8016 - protein, 9 aa, Artificial Sequence
  Description of Artificial Sequence: Synthetic peptide
QQGNTLPWT

SEQ ID NO: 8017 - protein, 9 aa, Artificial Sequence
  Description of Artificial Sequence: Synthetic peptide
LQGTHQPYT

SEQ ID NO: 8018 - protein, 9 aa, Artificial Sequence
  Description of Artificial Sequence: Synthetic peptide
QQYGSSPWT

SEQ ID NO: 8019 - protein, 9 aa, Artificial Sequence
  Description of Artificial Sequence: Synthetic peptide
HQYGSTPLT

SEQ ID NO: 8020 - protein, 10 aa, Artificial Sequence
  Description of Artificial Sequence: Synthetic peptide
QQYINWPPIT

SEQ ID NO: 8021 - protein, 11 aa, Artificial Sequence
  Description of Artificial Sequence: Synthetic peptide
KSRDGSGQHLV

SEQ ID NO: 8022 - protein, 9 aa, Artificial Sequence
  Description of Artificial Sequence: Synthetic peptide
QQNNEDPRT

SEQ ID NO: 8023 - protein, 9 aa, Artificial Sequence
  Description of Artificial Sequence: Synthetic peptide
QQYGSSPCT

SEQ ID NO: 8024 - protein, 9 aa, Artificial Sequence
  Description of Artificial Sequence: Synthetic peptide
QQYDNWPLT

SEQ ID NO: 8025 - protein, 9 aa, Artificial Sequence
  Description of Artificial Sequence: Synthetic peptide
QHHYGIPFT

SEQ ID NO: 8026 - protein, 9 aa, Artificial Sequence
  Description of Artificial Sequence: Synthetic peptide
MQALQTPYT

SEQ ID NO: 8027 - protein, 9 aa, Artificial Sequence
  Description of Artificial Sequence: Synthetic peptide
QNVHSFPFT

SEQ ID NO: 8028 - protein, 9 aa, Artificial Sequence
  Description of Artificial Sequence: Synthetic peptide
QQWSGYPYT

SEQ ID NO: 8029 - protein, 9 aa, Artificial Sequence
  Description of Artificial Sequence: Synthetic peptide
QQYNIYPYT

SEQ ID NO: 8030 - protein, 9 aa, Artificial Sequence
  Description of Artificial Sequence: Synthetic peptide
QQYYAYPWT

SEQ ID NO: 8031 - protein, 9 aa, Artificial Sequence
  Description of Artificial Sequence: Synthetic peptide
QQRSNWPIT

SEQ ID NO: 8032 - protein, 9 aa, Artificial Sequence
  Description of Artificial Sequence: Synthetic peptide
HQWNRYPYT

SEQ ID NO: 8033 - protein, 9 aa, Artificial Sequence
  Description of Artificial Sequence: Synthetic peptide
QHSRDLPLT

SEQ ID NO: 8034 - protein, 9 aa, Artificial Sequence
  Description of Artificial Sequence: Synthetic peptide
QQYYSYPLT

SEQ ID NO: 8035 - protein, 9 aa, Artificial Sequence
  Description of Artificial Sequence: Synthetic peptide
QQSSNWPRT

SEQ ID NO: 8036 - protein, 7 aa, Artificial Sequence
  Description of Artificial Sequence: Synthetic peptide
VLNTPLT

SEQ ID NO: 8037 - protein, 9 aa, Artificial Sequence
  Description of Artificial Sequence: Synthetic peptide
MQWSGYPYT

SEQ ID NO: 8038 - protein, 10 aa, Artificial Sequence
  Description of Artificial Sequence: Synthetic peptide
QQRSNWPPFT

SEQ ID NO: 8039 - protein, 213 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8040 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 8041 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 8042 - protein, 107 aa, Artificial Sequence [sequence omitted]

SEQ ID NO: 8043 - protein, 106 aa, Artificial Sequence; identical to SEQ ID NO: 3203
  Description of Artificial Sequence: Synthetic polypeptide

SEQ ID NO: 8044 - protein, 106 aa, Artificial Sequence; identical to SEQ ID NO: 3203
  Description of Artificial Sequence: Synthetic polypeptide

SEQ ID NO: 8045 - protein, 107 aa, Artificial Sequence [sequence omitted]

SEQ ID NO: 8046 - protein, 106 aa, Artificial Sequence; identical to SEQ ID NO: 3203
  Description of Artificial Sequence: Synthetic polypeptide

SEQ ID NO: 8047 - protein, 106 aa, Artificial Sequence; identical to SEQ ID NO: 3203
  Description of Artificial Sequence: Synthetic polypeptide

SEQ ID NO: 8048 - protein, 107 aa, Artificial Sequence [sequence omitted]

SEQ ID NO: 8049 - protein, 107 aa, Artificial Sequence
  Description of Artificial Sequence: Synthetic polypeptide
DIQMTQSPASLSVSVGETVTITCRASENIYSNLAWYRQKQGKSPQLLVFAASNLADGVPSRFSGSGSGTQYSLKINSLQSEDFGDYYCQHFWTTPWAFGGGTNLEIK

SEQ ID NO: 8050 - protein, 128 aa, Artificial Sequence
  Description of Artificial Sequence: Synthetic polypeptide
MSPSQLIGFLLLWVPASRGEIVLTQSPGTLSVSPGERATLSCRASQSIGSSLHWYQQKPGQAPRLLIYYASQSLSGIPDRFSGSGSGTDFTLTISRLEPEDFAVYYCHQSSRLPHTFGQGTKVEIKRT

SEQ ID NO: 8051 - protein, 128 aa, Artificial Sequence
  Description of Artificial Sequence: Synthetic polypeptide
MSPSQLIGFLLLWVPASRGEIVLTQSPDSLSVTPGERVTITCRASQSIGSSLHWYQQKPGQSPKLLIKYASQSLSGVPSRFSGSGSGTDFTLTISSLEAEDAAAYYCHQSSRLPHTFGQGTKVEIKRT

SEQ ID NO: 8052 - protein, 128 aa, Artificial Sequence
  Description of Artificial Sequence: Synthetic polypeptide
MSPSQLIGFLLLWVPASRGEIVLTQSPDSLSVTPGERVTITCRASQSIGSSLHWYQQKPGQSPKLLIKYASQSLSGVPSRFSGSGSGTDFTLTISSLEAEDFAVYYCHQSSRLPHTFGQGTKVEIKRT

SEQ ID NO: 8053 - protein, 128 aa, Artificial Sequence
  Description of Artificial Sequence: Synthetic polypeptide
MSPSQLIGFLLLWVPASRGEIVLTQSPGTLSVSPGERATLSCRASQSIGSSLHWYQQKPGQAPRLLIKYASQSLSGIPDRFSGSGSGTDFTLTISRLEPEDAAAYYCHQSSRLPHTFGQGTKVEIKRT

SEQ ID NO: 8054 - protein, 128 aa, Artificial Sequence
  Description of Artificial Sequence: Synthetic polypeptide
MSPSQLIGFLLLWVPASRGEIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKRT

SEQ ID NO: 8055 - protein, 128 aa, Artificial Sequence
  Description of Artificial Sequence: Synthetic polypeptide
MSPSQLIGFLLLWVPASRGEIVLTQVPDFQSVTPKEKVTITCRASQSIGSSLHWYQQKPDQSPKLLIKYASQSLSGVPSRFSGSGSGTDFTLTINSLEAEDAAAYYCHQSSRLPHTFGGGTKVEIKRT

SEQ ID NO: 8056 - protein, 128 aa, Artificial Sequence
  Description of Artificial Sequence: Synthetic polypeptide
MSPSQLIGFLLLWVPASRGEIVLTQSPDSLSVTPGERVTITCRASQSIGSSLHWYQQKPGQSPKLLIYYASQSLSGVPSRFSGSGSGTDFTLTISSLEAEDFAVYYCHQSSRLPHTFGQGTKVEIKRT

SEQ ID NO: 8057 - protein, 218 aa, Artificial Sequence
  Description of Artificial Sequence: Synthetic polypeptide
DIVLTQSPATLSVSPGERATISCRASQRVSSSTYSYMHWYQQKPGQPPKLLIKYASNLESGVPARFSGSGSGTDFTLTISSVEPEDFATYYCQHSWEIPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8058 - protein, 112 aa, Artificial Sequence
  Description of Artificial Sequence: Synthetic polypeptide
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLG

SEQ ID NO: 8059 - protein, 113 aa, Artificial Sequence [sequence omitted]

SEQ ID NO: 8060 - protein, 214 aa, Artificial Sequence
  Description of Artificial Sequence: Synthetic polypeptide
DIVMTQSPDSLAVSLGERATINCKSSQSLLNSGNQKNYLAWYQQKPGQPPKLLIYGASTRESGVPDRFSGSGSGTDFTLTISSLQAEDVAVYYCQNVHSFPFTFGGGTKLEIKRTVAAPSVFIFPPSDEQLKSGTASVVCLLNNFYPREAKVQWKVDNALQSGNSQESVTEQDSKDSTYSLSSTLTLSKEKHKVYACEVTHQSPVTKSFNRGEC

SEQ ID NO: 8061 - protein, 107 aa, Artificial Sequence
  Description of Artificial Sequence: Synthetic polypeptide
QVVLTQSPAIMSAFPGEKVTMTCSASSSVSYMNWYQQKSGTSPKRWIYDSSKLASGVPARFSGSGSGTSYSLTISSMETEDAATYYCQQWSRNPPTFGGGTKLQITR

SEQ ID NO: 8062 - protein, 106 aa, Artificial Sequence
  Description of Artificial Sequence: Synthetic polypeptide
DIQMTQSPSSLSASVGDRVTITCSASSSVSYMNWYQQKPGKAPKRLIYDSSKLASGVPSRFSGSGSGTEFTLTISSLQPEDFATYYCQQWSRNPPTFGGGTKVEIK

SEQ ID NO: 8063 - protein, 106 aa, Artificial Sequence
  Description of Artificial Sequence: Synthetic polypeptide
DVVMTQSPAIMSAFPGEKVTITCSASSSVSYMNWYQQKPGKAPKRWIYDSSKLASGVPSRFSGSGSGTEFTLTISSLQPEDFATYYCQQWSRNPPTFGGGTKVEIK

SEQ ID NO: 8064 - protein, 110 aa, Artificial Sequence
  Description of Artificial Sequence: Synthetic polypeptide
QAVVTQEPSLTVSPGGTVTLTCRSSTGAVTTSNYANWFQQKPGQAPRTLIGGTNKRAPWTPARFSGSLLGGKAALTITGAQAEDEADYYCALWYSNLWVFGGGTKLTVLG

SEQ ID NO: 8065 - protein, 110 aa, Artificial Sequence
  Description of Artificial Sequence: Synthetic polypeptide
QAVVTQEPSLTVSPGGTVTLTCRSSTGAVTTSNYANWVQQKPGQAPRTLIGGTNKRAPWTPARFSGSLLGGKAALTITGAQAEDEADYYCALWYSNLWVFGGGTKLTVLG

SEQ ID NO: 8066 - protein, 110 aa, Artificial Sequence
  Description of Artificial Sequence: Synthetic polypeptide
QAVVTQEPSLTVSPGGTVTLTCRSSTGAVTTSNYANWFQEKPGQAPRTLIGGTNKRAPWTPARFSGSLLGGKAALTITGAQAEDEADYYCALWYSNLWVFGGGTKLTVLG

SEQ ID NO: 8067 - protein, 110 aa, Artificial Sequence
  Description of Artificial Sequence: Synthetic polypeptide
QAVVTQEPSLTVSPGGTVTLTCRSSTGAVTTSNYANWFQQKPGQAPRGLIGGTNKRAPWTPARFSGSLLGGKAALTITGAQAEDEADYYCALWYSNLWVFGGGTKLTVLG

SEQ ID NO: 8068 - protein, 110 aa, Artificial Sequence
  Description of Artificial Sequence: Synthetic polypeptide
QAVVTQEPSLTVSPGGTVTLTCRSSTGAVTTSNYANWVQEKPGQAPRTLIGGTNKRAPWTPARFSGSLLGGKAALTITGAQAEDEADYYCALWYSNLWVFGGGTKLTVLG

SEQ ID NO: 8069 - protein, 110 aa, Artificial Sequence
  Description of Artificial Sequence: Synthetic polypeptide
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLG

SEQ ID NO: 8070 - protein, 110 aa, Artificial Sequence
  Description of Artificial Sequence: Synthetic polypeptide
QAVVTQEPSLTVSPGGTVTLTCRSSTGAVTTSNYANWFQEKPGQAPRGLIGGTNKRAPWTPARFSGSLLGGKAALTITGAQAEDEADYYCALWYSNLWVFGGGTKLTVLG

SEQ ID NO: 8071 - protein, 110 aa, Artificial Sequence
  Description of Artificial Sequence: Synthetic polypeptide
QAVVTQEPSLTVSPGGTVTLTCRSSTGAVTTSNYANWVQEKPGQAPRGLIGGTNKRAPWTPARFSGSLLGGKAALTITGAQAEDEADYYCALWYSNLWVFGGGTKLTVLG

SEQ ID NO: 8072 - protein, 110 aa, Artificial Sequence
  Description of Artificial Sequence: Synthetic polypeptide
QAVVTQEPSLTVSPGGTVTLTCRSSTGAVTTSNYANWVQEKPGQAFRGLIGGTNKRAPWTPARFSGSLLGGKAALTITGAQAEDEADYYCALWYSNLWVFGGGTKLTVLG

SEQ ID NO: 8073 - protein, 110 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVLG

SEQ ID NO: 8074 - protein, 113 aa, Artificial Sequence
  Description of Artificial Sequence: Synthetic polypeptide
DIVMTQSPDSLAVSLGERATINCKSSQSLLYSRNQKNYLAWYQQKPGQPPKLLIFWASTRESGVPDRFSGSGFGTDFTLTISSLQAEDVAVYYCQQYFSYPLTFGQGTKVEIK

SEQ ID NO: 8075 - protein, 112 aa, Artificial Sequence
  Description of Artificial Sequence: Synthetic polypeptide
DIVMTQSPDSLAVSLGERATINCKSSQSLLYSRNQKNYLAWFQQKPGQPPKLLIFWASTRESGVPDRFSGSGFGTDFTLTISSLQAEDVAVYDCQQYFSYPLTFGQGTKVEI

SEQ ID NO: 8076 - protein, 113 aa, Artificial Sequence
  Description of Artificial Sequence: Synthetic polypeptide
DIVMTQSPDSLAVSLGERATINCKSSQSLLYSRNQKNYLAWYQQKPGQPPKLLIYWASTRESGVPDRFSGSGFGTDFTLTISSLQAEDVAVYYCQQYFSYPLTFGQGTKVEIK

SEQ ID NO: 8077 - protein, 106 aa, Artificial Sequence
  Description of Artificial Sequence: Synthetic polypeptide
QIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIK

SEQ ID NO: 8078 - protein, 113 aa, Artificial Sequence
  Description of Artificial Sequence: Synthetic polypeptide
DIVMSQSPSSLAVSVGEKVTMSCKSSQSLLYSNNQKNYLAWYQQKPGQSPKLLIYWASTRESGVPDRFTGSGSGTDFTLTISSVKAEDLAVYYCHQYYTSPYTFGGGTNLEIK

SEQ ID NO: 8079 - protein, 112 aa, Artificial Sequence
  Description of Artificial Sequence: Synthetic polypeptide
DVLMTQTPLSLPVSLGDQASISCRSSQSIVHSDGNTYLEWYLRKPGQSPRLLIYKVSNRFSGVPDRFSGSGSGTDFTLKISRVEAEDLGVYYCFQGSHAPWTFGGGTKLEIK

SEQ ID NO: 8080 - protein, 113 aa, Artificial Sequence
  Description of Artificial Sequence: Synthetic polypeptide
DIVMSQSPSSLTVSVGEKGTMSCKSSQSLLYSSNQKNYLAWYQQKPGQSPKLLIYWASTRESGVPDRFTGSGSGTDFSLTISSVLAEDLAVYFCHQYYSSPYTFGGGTKLEIK

SEQ ID NO: 8081 - protein, 108 aa, Artificial Sequence
  Description of Artificial Sequence: Synthetic polypeptide
QIVLTQSPAIMSASPGERVTLTCSASSSVSSSFLYWYQQKSGSSPKLWIYSTSTLASGVPARFSGSGSGTSYSLTISSMEAEDAASYFCHQWSSYPWTFGGGTKLEIK

SEQ ID NO: 8082 - protein, 113 aa, Artificial Sequence
  Description of Artificial Sequence: Synthetic polypeptide
DIVMTQSPSSLAMSVGQKVTMSCKSSQSLLNSSTQKNYLAWYQQKPGQSPKLLIYFASTRGSGVPDRFIGSGSGTDFTLTISSVQTEDLADYFCQQHYSIPCTFGGGTKLEIK

SEQ ID NO: 8083 - protein, 103 aa, Artificial Sequence
  Description of Artificial Sequence: Synthetic polypeptide
DIQMNQSPSSLSASLGDTITITCHVSQNINVWLTWYQQKPGNIPKLLLYKASNLQTGVPSRFSGSGSGTGFTLTISSLQPEDIATYYCQQGQSYPFTFGSGTK

SEQ ID NO: 8084 - protein, 111 aa, Artificial Sequence
  Description of Artificial Sequence: Synthetic polypeptide
DIVMSQSPSSLAVSVGEKVTMSCKSSQSLLYSNNQKNYLAWYQQKPGQSPKLLIYWASSRESGVPERFTGSGSGTDFTLTISSVKAEDLAVYYCQQYYSSPYTFGGGTKLK

SEQ ID NO: 8085 - protein, 107 aa, Artificial Sequence
  Description of Artificial Sequence: Synthetic polypeptide
DIVMTQSQKFMSTSVGDRVSVTCKASQNVAINVAWYQQKPGQSPKALIYSASYRYSVVPDRFTGSGSGTDFTLPISNVQSEGLADYFCLQYINYPYTFGGGTKLEIK

SEQ ID NO: 8086 - protein, 106 aa, Artificial Sequence
  Description of Artificial Sequence: Synthetic polypeptide
QIVLSQSPAILSASPGEKVTMTCRASSSVSYIHWYQQKAGSSPTSWIYATSNLASGVPTRFSGSGSGTSYSLTVNRVEAEDAATYYCQQWSTTPPTFGGGTRLEIK

SEQ ID NO: 8087 - protein, 110 aa, Artificial Sequence
  Description of Artificial Sequence: Synthetic polypeptide
DIVMTQSPSSLTVTAGEKVTMSCKSSQSLLKSGNQKNYLTWYQQKPGQPPKLLIYWASTRESGVPDRFTGSGFGTDFTLTISSVQAEDLAVYYCQSDYNYPTFGSGTKLK

SEQ ID NO: 8088 - protein, 106 aa, Artificial Sequence
  Description of Artificial Sequence: Synthetic polypeptide
QIVLTQSPAIMSASPGEKVTITCSASSSVSYMHWFQQKPGTSPKLWIYSTSNLASGVPARFSGSGSGTSYSLTISRMEAEDAATYYCQQRSTYPYTFGGGTKLEIK

SEQ ID NO: 8089 - protein, 106 aa, Artificial Sequence
  Description of Artificial Sequence: Synthetic polypeptide
QIVLSQSPAILSASPGEKVTMTCRASSSVSYMHWYQQKPGSSPKPWIYAASNLASGVPARFSATGSGTSYSLTISRVEAEDAATYCCQQWSNNPPTFGGGTKLEIK

SEQ ID NO: 8090 - protein, 111 aa, Artificial Sequence
  Description of Artificial Sequence: Synthetic polypeptide
DIVLTQSPASLAVSLGQRATISCRANESVEYYGTSLMQWYQQKPGQPPKLLIYAASSVKSGVPARFSGSGSGTDFSLNIHPVEEDDIAMYFCQQSRKVPSTFGGGTKLEIK

SEQ ID NO: 8091 - protein, 111 aa, Artificial Sequence
  Description of Artificial Sequence: Synthetic polypeptide
DIVLTQSPASLAVSLGQRATISCRAHESVEYYGTSLMQWYQQKPGQPPKLLIYAASSVKSGVPARFSGSGSGTDFSLNIHPVEEDDIAMYFCQQSRKVPSTFGGGTKLEIK

SEQ ID NO: 8092 - protein, 113 aa, Artificial Sequence
  Description of Artificial Sequence: Synthetic polypeptide
DIVMTQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYNYPYTFGGGTKLEIK

SEQ ID NO: 8093 - protein, 109 aa, Artificial Sequence
  Description of Artificial Sequence: Synthetic polypeptide
DIVLTQSPASLAVSLGQRATISCRANENVEYYGTSLMQWYQQKPGQPPKLLIYAASNVKSGVPARFSGSGSGTDFSLNIHPVEEDDIAMYFCQQSRKVPSTFGGGTKLK

SEQ ID NO: 8094 - protein, 113 aa, Artificial Sequence
  Description of Artificial Sequence: Synthetic polypeptide
DIVMSQSPSSLAVSVGEKVTMSCKSSQSLLYSSNQKNYLAWYQQKPGQSPKLLIYWASTRESGVPDRFTGSGSGTDFTLTISTVKAEDLAVYYCHQYYSYPYTFGGGTKLEIK

SEQ ID NO: 8095 - protein, 111 aa, Artificial Sequence
  Description of Artificial Sequence: Synthetic polypeptide
DIVLTQSPGSLAVSLGQRATISCRASQSVSSSSYSYMHWYQQKPGQPPKLLIKFASNLESGVPARFSGSGSGTDFTLNIHPVEEEDTATYYCQHSWEIPLTFGAGTKLELK

SEQ ID NO: 8096 - protein, 107 aa, Artificial Sequence
  Description of Artificial Sequence: Synthetic polypeptide
DVQITQSPSYLAASPGETISINCRASKNISKYLAWYQEKPGKTNKLLIYSGSTLQSGIPSGFSGSGSGTDFTLTISSLEPEDFAMYYCQQHFEYPYTFGGGTKLEIK

SEQ ID NO: 8097 - protein, 105 aa, Artificial Sequence
  Description of Artificial Sequence: Synthetic polypeptide
QIVLTQSPAIMSASLGEEITLTCSATSSVGYIHWYQQTSGTSPRLLIYTTSNLASGVPSRFSGSGSGTFYSLTISSVEAEDAADYYCHQWSRYPTFGGGTKLEIK

SEQ ID NO: 8098 - protein, 107 aa, Artificial Sequence
  Description of Artificial Sequence: Synthetic polypeptide
DIKMTQSPSSTYASLGERVTITCKASQDINTYLYWFQQKPGKPPKTLIYRANRLIDGVPSRFSGSGSGQDYSLTISSLEYEDLGIYYCLQYDEFPYTFGGGTKLEIK

SEQ ID NO: 8099 - protein, 111 aa, Artificial Sequence
  Description of Artificial Sequence: Synthetic polypeptide
DIVLTQSPASLAVSLGQRATISCRADESVEYYGTSLMQWYQQKPGQPPKLLIYAASNVKSGVPARFSGSGSGTDFSLNIHPVEEDDIAIYFCQQSREVPSTFGGGTKLEIK

SEQ ID NO: 8100 - protein, 112 aa, Artificial Sequence
  Description of Artificial Sequence: Synthetic polypeptide
DIVMTQAAFSNPVTLGTSASISCRSSKSLLHSNGITYLYWYLQKPGQSPQLLIYQMSNLASGVPDRFSNSGSGTDFTLRISRVEAEDVGVYYCAQNLELPWTFGGGTKLEIK

SEQ ID NO: 8101 - protein, 108 aa, Artificial Sequence
  Description of Artificial Sequence: Synthetic polypeptide
DIVMTQSHKLMSASVGDRVSITCKASQDVGTAVAWYQQKPGRSPKLLIYWASNRHTGVPDRFTGSGSGTDFTLTISNVQSEDLADYFCQQFGSYPYTFGGGTKLEIKR

SEQ ID NO: 8102 - protein, 111 aa, Artificial Sequence
  Description of Artificial Sequence: Synthetic polypeptide
DIVLTQSPLSLLVSLGDQASISCRSSQSLVHSNGNTYLHWYLQKPGQSPNLLIFKVSNRFSGVPDRFSGSGSGTDFTLRISRVEAEDLGVYFCSQTTHVWTFGGGTKLEIK

SEQ ID NO: 8103 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIK

SEQ ID NO: 8104 - protein, 219 aa, Artificial Sequence; identical to SEQ ID NO: 7618
  Description of Artificial Sequence: Synthetic polypeptide

SEQ ID NO: 8105 - protein, 110 aa, Artificial Sequence
  Description of Artificial Sequence: Synthetic polypeptide
QAVVTQEPSLTVSPGGTVTLTCRSSTGAVTTSNYANWFQQKPDHLFTGLIGGTNKRAPWTPARFSGSLLGGKAALTITGAQAEDEADYYCALWYSNLWVFGGGTKLTVLG

SEQ ID NO: 8106 - protein, 110 aa, Artificial Sequence
  Description of Artificial Sequence: Synthetic polypeptide
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIK

SEQ ID NO: 8107 - protein, 108 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKR

SEQ ID NO: 8108 - protein, 107 aa, Artificial Sequence [sequence omitted]

SEQ ID NO: 8109 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPFLTFGGGTKVEIKR

SEQ ID NO: 8110 - protein, 76 aa, Artificial Sequence
  Description of Artificial Sequence: Synthetic polypeptide
TITCQASQDISNYLNWYQQKPGKAPKLLIYDASNLETGVPSRFSGSGSGTDFTFTISSLQPEDIATYYCQQYDNLP

SEQ ID NO: 8111 - protein, 109 aa, Artificial Sequence
  Description of Artificial Sequence: Synthetic polypeptide
SSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVLG

SEQ ID NO: 8112 - protein, 107 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 8113 - protein, 112 aa, Artificial Sequence
  Description of Artificial Sequence: Synthetic polypeptide
DIVMTQSPDSLAVSLGERATINCKSSQSLLNSRTRKNYLAWYQQKPGQPPKLLIYWASTRESGVPDRFSGSGSGTDFTLTISSLQAEDVAVYYCTQSFILRTFGQGTKVEIK

SEQ ID NO: 8114 - protein, 112 aa, Artificial Sequence
  Description of Artificial Sequence: Synthetic polypeptide
DIVMTQSPSSLAVSAGEKVTMSCKSSQSLLNSRTRKNYLAWYQQKPGQSPKLLIYWASTRESGVPDRFTGSGSGTDFTLTISSVQAEDLAVYYCTQSFILRTFGGGTKLEIK

SEQ ID NO: 8115 - protein, 112 aa, Artificial Sequence
  Description of Artificial Sequence: Synthetic polypeptide
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIK

SEQ ID NO: 8116 - protein, 112 aa, Artificial Sequence; identical to SEQ ID NO: 8115
  Description of Artificial Sequence: Synthetic polypeptide

SEQ ID NO: 8117 - protein, 112 aa, Artificial Sequence
  Description of Artificial Sequence: Synthetic polypeptide
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFALRTFGQGTKVEIK

SEQ ID NO: 8118 - protein, 112 aa, Artificial Sequence
  Description of Artificial Sequence: Synthetic polypeptide
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKASFILRTFGQGTKVEIK

SEQ ID NO: 8119 - protein, 112 aa, Artificial Sequence
  Description of Artificial Sequence: Synthetic polypeptide
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSAILRTFGQGTKVEIK

SEQ ID NO: 8120 - protein, 112 aa, Artificial Sequence; identical to SEQ ID NO: 8115
  Description of Artificial Sequence: Synthetic polypeptide

SEQ ID NO: 8121 - protein, 112 aa, Artificial Sequence; identical to SEQ ID NO: 8115
  Description of Artificial Sequence: Synthetic polypeptide

SEQ ID NO: 8122 - protein, 112 aa, Artificial Sequence; identical to SEQ ID NO: 8115
  Description of Artificial Sequence: Synthetic polypeptide

SEQ ID NO: 8123 - protein, 112 aa, Artificial Sequence; identical to SEQ ID NO: 8115
  Description of Artificial Sequence: Synthetic polypeptide

SEQ ID NO: 8124 - protein, 112 aa, Artificial Sequence
  Description of Artificial Sequence: Synthetic polypeptide
DIVMTQSPDSLAVSLGERATINCKSSQSLLNSRTRKNYLAWYQQKPGQSPKLLIYWTSTRKSGVPDRFSGSGSGTDFTLTISSLQAEDVAVYYCTQSFILRTFGQGTKVEIK

SEQ ID NO: 8125 - protein, 107 aa, Artificial Sequence
  Description of Artificial Sequence: Synthetic polypeptide
DIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKLELK

SEQ ID NO: 8126 - protein, 107 aa, Artificial Sequence [sequence omitted]

SEQ ID NO: 8127 - protein, 107 aa, Artificial Sequence [sequence omitted]

SEQ ID NO: 8128 - protein, 109 aa, Artificial Sequence
  Description of Artificial Sequence: Synthetic polypeptide
EAVVTQEPSLTVSPGGTVTLTCRSSTGAVTTSNYANWVQQKPGQAPRGLIGGTNKRAPWTPARFSGSLLGGKAALTLSGAQPEDEAEYYCALWYSNLWVFGGGTKLTVL

SEQ ID NO: 8129 - protein, 109 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 8130 - protein, 109 aa, Artificial Sequence
  Description of Artificial Sequence: Synthetic polypeptide
QAVVTQEPSLTVSPGGTVTLTCRSSTGAVTTSNYANWFQQKPGQAPRTLIYGTSNRAPWTPARFSGSLLGGKAALTLSGAQPEDEAEYFCALWYSTHFVFGTGTKVTVL

SEQ ID NO: 8131 - protein, 108 aa, Artificial Sequence
  Description of Artificial Sequence: Synthetic polypeptide
QAVVTQESALTTSPGGTVILTCRSSTGAVTTSNYANWVQEKPDHLFTGLIGGTSNRAPGVPVRFSGSLIGDKAALTITGAQTEDDAMYFCALWYSTHFVFGGGTKVTV

SEQ ID NO: 8132 - protein, 112 aa, Artificial Sequence
  Description of Artificial Sequence: Synthetic polypeptide
DIVMTQSPDSLAVSLGERATINCKSSQSLLNSRTRKNYLAWYQQKPGQPPKLLIYWASTRESGVPDRFSGSGSGTDFTLTISSLQAEDVAVYYCKQSYILRTFGQGTKVEIK

SEQ ID NO: 8133 - protein, 112 aa, Artificial Sequence; identical to SEQ ID NO: 8132
  Description of Artificial Sequence: Synthetic polypeptide

SEQ ID NO: 8134 - protein, 112 aa, Artificial Sequence
  Description of Artificial Sequence: Synthetic polypeptide
DIVLTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYILRTFGGGTKLEIK

SEQ ID NO: 8135 - protein, 112 aa, Artificial Sequence
  Description of Artificial Sequence: Synthetic polypeptide
DIVMTQSPDSLAVSLGERATINCKSSQSLLSGRTRKNYLAWYQQKPGQPPKLLIYWASTRESGVPDRFSGSGSGTDFTLTISSLQAEDVAVYYCKQSYYLLTFGQGTKVEIK

SEQ ID NO: 8136 - protein, 112 aa, Artificial Sequence
  Description of Artificial Sequence: Synthetic polypeptide
NIVMTQSPSSLAVSAGEKVTMSCKSSQSLLSGRTRKNYLAWYQQKPGQSPKLLIYWASTRESGVPDRFTGSGSGTDFTLTISSVQAEDLAVYYCKQSYYLLTFGAGTKLELK

SEQ ID NO: 8137 - protein, 112 aa, Artificial Sequence; identical to SEQ ID NO: 8135
  Description of Artificial Sequence: Synthetic polypeptide

SEQ ID NO: 8138 - protein, 113 aa, Artificial Sequence
  Description of Artificial Sequence: Synthetic polypeptide
DIQMTQSPSSLAVSLGERATINCKSSQSVLYSSNNKNYLVWYQQKLGQPPKLLIYRASTRESGVPDRFSGSGSGTDFTLTISSLQAEDVAVYYCQQYYSVPWTFGQGTKVEIK

SEQ ID NO: 8139 - protein, 112 aa, Artificial Sequence
  Description of Artificial Sequence: Synthetic polypeptide
DIVMTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSFTLRTFGQGTKVEIK

SEQ ID NO: 8140 - protein, 112 aa, Artificial Sequence
  Description of Artificial Sequence: Synthetic polypeptide
DIVMTQSPSSLAVSAGETVTMNCKSSQSLLNSRTRKNYLAWYQQKPGQSPKLLIYWASTRESGVPDRFTGSGSGTDFTLTISTVQAEDLAVYYCKQSYTLRTFGQGTKVEIK

SEQ ID NO: 8141 - protein, 112 aa, Artificial Sequence
  Description of Artificial Sequence: Synthetic polypeptide
EIVLSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYTLRTFGGGTKLEIK

SEQ ID NO: 8142 - protein, 112 aa, Artificial Sequence
  Description of Artificial Sequence: Synthetic polypeptide
GIVMTQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYILRTFGGGTKLEIK

SEQ ID NO: 8143 - protein, 108 aa, Artificial Sequence; identical to SEQ ID NO: 8131
  Description of Artificial Sequence: Synthetic polypeptide

SEQ ID NO: 8144 - protein, 112 aa, Artificial Sequence
  Description of Artificial Sequence: Synthetic polypeptide
DVVMTQTPSSLAVSTGEKVTMTCKSSQSLLNIRTRKNCLAWYQQKPGQSPKLLIFWASTRYSGVPDRFTGSGSGTDFTLTIRSVQPEDLAVYYCTQSYTLRTFGGGTKLEIK

SEQ ID NO: 8145 - protein, 112 aa, Artificial Sequence
  Description of Artificial Sequence: Synthetic polypeptide
DIVMTQSPSSLAVSAGEKVTMSCKSSQSLLNSRTRKNYLAWYQQKPGQSPKLLIYWASTRESGVPDRFTGSGSGTDFTLTISSVQTEDLAVYYCCQSFILRTFGGGTKLEIK

SEQ ID NO: 8146 - protein, 112 aa, Artificial Sequence
  Description of Artificial Sequence: Synthetic polypeptide
DIVMTQSPSSLAVSAGEKVTMTCKSSQSLLNSRTRKNYLAWYQQKPGQSPKLLIYWASTRESGVPDRFTGSGSGTDFTLTISSVQAEDLAVYYCKQSFILRTFGGGTKLELK

SEQ ID NO: 8147 - protein, 112 aa, Artificial Sequence
  Description of Artificial Sequence: Synthetic polypeptide
DIVMTQSPSSLAVSVGEKVTMSCKSSQSLLNSRTRKNYLAWYQQKPGQSPKLLIYWASTRESGVPVRFTGSGSGTDFTLTISSVQAEDLAVYYCTQSFILRTFGGGTKLEIK

SEQ ID NO: 8148 - protein, 112 aa, Artificial Sequence
  Description of Artificial Sequence: Synthetic polypeptide
DIVMTQSPSSLAVSAGEKVTMTCKSSQSLLNSRTRKNYLAWYQQKPGQSPKLLIYWASTRESGVPDRFTGSGSGTDFTLTISSVQAEDLAVYYCKQSFILRTFGGGTKLEIK

SEQ ID NO: 8149 - protein, 112 aa, Artificial Sequence
  Description of Artificial Sequence: Synthetic polypeptide
DIVMTQSPSSLAVSAGEKVTMSCKSSQSLLNSRTRKNYLAWYQQKPGQSPKLLIFWASTRESGVPDRFTGSGSGTDFTLTISSVQAEDLAVYYCKQSFILRTFGGGTKLELK

SEQ ID NO: 8150 - protein, 112 aa, Artificial Sequence; identical to SEQ ID NO: 8145
  Description of Artificial Sequence: Synthetic polypeptide

SEQ ID NO: 8151 - protein, 112 aa, Artificial Sequence
  Description of Artificial Sequence: Synthetic polypeptide
DIVMTQSPSSLAVSAGEMVTLHCKSSQSLLNIRTRKNYLAWYLQKPGQSPRLLIYWASTRASGVPDRFTGSGSGTDFTLTISSVQPEDLAVYYCTQSFILRTFGGGTKLELK

SEQ ID NO: 8152 - protein, 112 aa, Artificial Sequence
  Description of Artificial Sequence: Synthetic polypeptide
DIVMTQSPSSLAVSAGEKVTMSCKSSQSLLNSRTRKNYLAWYQQKPGLSPKLLIYWASTRESGVPERFTGSGSGTDFTLTISSVQTEDLAVYYCTQSFILRTFGGGTRLEIK

SEQ ID NO: 8153 - protein, 110 aa, Artificial Sequence
  Description of Artificial Sequence: Synthetic polypeptide
DMTQTPSSKSVPVGDTVTINCQASETVYSNNYLAWFQQKPGQPPKRLIYGVSTLDSGVPPRFSGSGSGTQFTLTISDVVCDDAATYYCAGYKTSSSYAIAFGGGTELEIL

SEQ ID NO: 8154 - protein, 114 aa, Artificial Sequence; identical to SEQ ID NO: 7393
  Description of Artificial Sequence: Synthetic polypeptide

SEQ ID NO: 8155 - protein, 107 aa, Artificial Sequence
  Description of Artificial Sequence: Synthetic polypeptide
DIAMTQSQKFMSTSVGDRVSVTCKASQNVDTNVAWYQQKPGQSPKALIYSASYRYSGVPDRFTGSGSGTDFTLTINNVQSEDLAEYFCQQYNNYPFTFGSGTKLEIK

SEQ ID NO: 8156 - protein, 107 aa, Artificial Sequence
  Description of Artificial Sequence: Synthetic polypeptide
DIQMTQTTSSLSASLGDRVTISCRASQDISNYLNWYQQKPDGTVKLLIYYTSRLHSGVPSRFSGSGSGTDYSLTIDNLEQEDIATYFCQQGNTLPPTFGGGTKLEIK

SEQ ID NO: 8157 - protein, 108 aa, Artificial Sequence
  Description of Artificial Sequence: Synthetic polypeptide
DIQMTQSPASLSVSVGETVTITCRASESIYSYLAWYQQKQGKSPQLLVYNTKTLPEGVPSRFSGSGSGTQFSLKINSLQPEDFGRYYCQHHYGTPPWTFGGGTNLEIK

SEQ ID NO: 8158 - protein, 107 aa, Artificial Sequence
  Description of Artificial Sequence: Synthetic polypeptide
DIQMTQSPSSLSASVGDRVTITCGASENIYHALNWYQQKPGKAPKLLIYGATNLADGVPSRFSGSGSGTDFTLTISSLQPEDFATYYCQNVLNTPLTFGQGTKVEIK

SEQ ID NO: 8159 - protein, 107 aa, Artificial Sequence [sequence omitted]

SEQ ID NO: 8160 - protein, 111 aa, Artificial Sequence
  Description of Artificial Sequence: Synthetic polypeptide
NIVLTQSPVSLAVSLGQRATISCRASESVDSHGNSFMHWYQQKPGQPPKLLIYLASNLESGVPARFTGGGSGSDFTLTIDPVEADDVGTYYCQQNNEDPYTFGGGTKLEIK

SEQ ID NO: 8161 - protein, 107 aa, Artificial Sequence
  Description of Artificial Sequence: Synthetic polypeptide
DVVLTQSPATLSVTPGDRVSLSCRASQSVSKYLHWYQQKSHESPRLLIKYVSQSISGIPSRFSGSGSGTDFTLSINSVETEDLGMYFCQQSNSWPHTFGAGTKLELK

SEQ ID NO: 8162 - protein, 110 aa, Artificial Sequence
  Description of Artificial Sequence: Synthetic polypeptide
QAVVTQESALTTSPGETVTLTCRSNTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 8163 - protein, 110 aa, Artificial Sequence; identical to SEQ ID NO: 8162
  Description of Artificial Sequence: Synthetic polypeptide

SEQ ID NO: 8164 - protein, 107 aa, Artificial Sequence
  Description of Artificial Sequence: Synthetic polypeptide
DIQMTQSPSSLSASVGDRVTITCRGSGNIHNYLAWYQQKPGKAPKLLVYNAKTLADGVPSRFSGSGSGTDYTLTISSLQPEDFATYYCQHFWSTPYTFGGGTKVEIK

SEQ ID NO: 8165 - protein, 110 aa, Artificial Sequence
  Description of Artificial Sequence: Synthetic polypeptide
SAEVTQPPSVSVSPGQTARITCSSNTGAVTTSNYANWVQQKPGQAPVGLIGGTNERPSGIPERFSGSSSGNTATLTISGAQAEDEADYYCALWYSNHWVFGGGTKLTVLG

SEQ ID NO: 8166 - protein, 107 aa, Artificial Sequence
  Description of Artificial Sequence: Synthetic polypeptide
DIQMTQSPASLSASVGETVTITCRGSGNIHNYLAWYQQKQGKSPQLLVYNAKTLADGVPSRFSGSGSGTQYSLKINSLQPEDFGSYYCQHFWSTPYTFGGGTKLEIK

SEQ ID NO: 8167 - protein, 112 aa, Artificial Sequence
  Description of Artificial Sequence: Synthetic polypeptide
DILLTQTPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKR

SEQ ID NO: 8168 - protein, 114 aa, Artificial Sequence; identical to SEQ ID NO: 7521
  Description of Artificial Sequence: Synthetic polypeptide

SEQ ID NO: 8169 - protein, 107 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEIT

SEQ ID NO: 8170 - protein, 115 aa, Artificial Sequence
  Description of Artificial Sequence: Synthetic polypeptide
DIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRAD

SEQ ID NO: 8171 - protein, 146 aa, Artificial Sequence
  Description of Artificial Sequence: Synthetic polypeptide
MSPAQFLFLLVLWIQETNGDVGMTQTPLTLSVTIGQPASFSCKSSQSLLYSNGKTYLNWLLQRPGQSPKRLIHLVSKLDSGVPDRFTGSGSGTDFTLKIGRVEAEDLGVYYCVQGTHFPYTFGGGTKLEIKRADAAPTVSIFPPSS

SEQ ID NO: 8172 - protein, 146 aa, Artificial Sequence
  Description of Artificial Sequence: Synthetic polypeptide
MEKDTLLLWVLLLWVPGSTGDIVLTQSPTSLAVSLGQRATISCRASESVDTFGISFMNWFQQKPGQPPKLLIHAASNQGSGVPARFSGSGSGTDFSLNIHPMEEDDSAMYFCQQSKEVPFTFGSGTKLEIKRADAAPTVSIFPPSS

SEQ ID NO: 8173 - protein, 111 aa, Artificial Sequence
  Description of Artificial Sequence: Synthetic polypeptide
EIVLTQSPDFQSVTPKEKVTITCRASESVDTFGISFMNWFQQKPDQSPKLLIHEASNQGSGVPSRFSGSGSGTDFTLTINSLEAEDAATYYCQQSKEVPFTFGGGTKVEIK

SEQ ID NO: 8174 - protein, 112 aa, Artificial Sequence
  Description of Artificial Sequence: Synthetic polypeptide
DIQLTQSPSSLSASVGDRVTITCKASQSVDYDGDSYLNWYQQIPGKAPKLLIYDASNLVSGIPPRFSGSGSGTDYTFTISSLQPEDIATYHCQQSTEDPWTFGGGTKLQIKR

SEQ ID NO: 8175 - protein, 112 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKR

SEQ ID NO: 8176 - protein, 108 aa, Artificial Sequence
  Description of Artificial Sequence: Synthetic polypeptide
DIQMTQSPSSLSASVGDRVTITCQASQDIIKYLNWYQQTPGKAPKLLIYEANSLQAGVPSRFSGSGSGTDYTFTISSLQPEDIATYYCQQYQSLPYTFGQGTKLQITR

SEQ ID NO: 8177 - protein, 112 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLQIKR

SEQ ID NO: 8178 - protein, 112 aa, Artificial Sequence; identical to SEQ ID NO: 8174
  Description of Artificial Sequence: Synthetic polypeptide

SEQ ID NO: 8179 - protein, 108 aa, Artificial Sequence; identical to SEQ ID NO: 8176
  Description of Artificial Sequence: Synthetic polypeptide

SEQ ID NO: 8180 - protein, 112 aa, Artificial Sequence; identical to SEQ ID NO: 8174
  Description of Artificial Sequence: Synthetic polypeptide

SEQ ID NO: 8181 - protein, 120 aa, Artificial Sequence
  Description of Artificial Sequence: Synthetic polypeptide
VQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFDVWGQGTTVTVSS

SEQ ID NO: 8182 - protein, 120 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFDVWGQGTTVTVS

SEQ ID NO: 8183 - protein, 107 aa, Artificial Sequence
  Description of Artificial Sequence: Synthetic polypeptide
DIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKR

SEQ ID NO: 8184 - protein, 106 aa, Artificial Sequence
  Description of Artificial Sequence: Synthetic polypeptide
DIQMTQSPSSLSASVGDRVTITCKTSQDINKYMAWYQQTPGKAPRLLIHYTSALQPGIPSRFSGSGSGRDYTFTISSLQPEDIATYYCLQYDNLWTFGQGTEVEIK

SEQ ID NO: 8185 - protein, 111 aa, Artificial Sequence
  Description of Artificial Sequence: Synthetic polypeptide
QIVMSQSPAILSASPGEKVTMTCRARSSVSYIHWYQQKPGSSPKPWIYATSNLASGVPGRFSGSGSGTSYSLTITRVEAEDAATYYCQQWSSKPPTFGGGTKLEIKRTDAA

SEQ ID NO: 8186 - protein, 108 aa, Artificial Sequence
  Description of Artificial Sequence: Synthetic polypeptide
QIVMSQSPAILSASPGEKVTMTCRARSSVSYIHWYQQKPGSSPKPWIYATSNLASGVPGRFSGSGSGTSYSLTITRVEAEDAATYYCQQWSSKPPTFGGGTKLEIKRA

SEQ ID NO: 8187 - protein, 107 aa, Artificial Sequence
  Description of Artificial Sequence: Synthetic polypeptide
EIVMTQSPATLSVSPGERTTLSCRASQSVSSNLAWYLQKPGQAPRLLIYGASTRATGIPARFSGSGSGTEFILTISSLQSEDFAVYYCQQYNNWPITFGQGTRLEIK

SEQ ID NO: 8188 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGTSTRATGIPARFSGSGSGTEFTLTISSLQSEDFAVYYCQQYNNWPLTFGGGTKVEIK

SEQ ID NO: 8189 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPITFGQGTRLEIK

SEQ ID NO: 8190 - protein, 107 aa, Artificial Sequence; identical to SEQ ID NO: 8189
  Description of Artificial Sequence: Synthetic polypeptide

SEQ ID NO: 8191 - protein, 107 aa, Artificial Sequence; identical to SEQ ID NO: 8189
  Description of Artificial Sequence: Synthetic polypeptide

SEQ ID NO: 8192 - protein, 107 aa, Artificial Sequence
  Description of Artificial Sequence: Synthetic polypeptide
EIVLTQSPATLSLSPGERATLSCRASQSVSSYLVWYQQRPGQAPRLLIYEASNRATGIPARFSGSGSGTDFTLTISSLESEDFAVYYCQQRSNWPLTFGGGTKVEIK

SEQ ID NO: 8193 - protein, 107 aa, Artificial Sequence
  Description of Artificial Sequence: Synthetic polypeptide
EIVLTQSPATLSLSPGERATLSCRASQSVSSYLAWYQQKPGQAPRLLIYEASNRATGIPARFSGSGSGTDFTLTISSLEPEDFAVYYCQQRSNWPLTFGGGTKVEIK

SEQ ID NO: 8194 - protein, 107 aa, Artificial Sequence
  Description of Artificial Sequence: Synthetic polypeptide
EIVMTQSPATLSVSPGERATLSCRASQSVSHNLAWYQQKPGQAPRLLIYGAYTRATGIPDRFSGTGSGTEFTLTISSLQSEDFAVFYCQQYNNWPLTFGGGTKVEIK

SEQ ID NO: 8195 - protein, 107 aa, Artificial Sequence
  Description of Artificial Sequence: Synthetic polypeptide
EIVMTQSPATLSVSPGERATLSCRASQSVSHNLAWYQQKPGQAPRLLIYGAYTRATGIPARFSGSGSGTEFTLTISSLQSEDFAVYYCQQYNNWPLTFGGGTKVEIK

SEQ ID NO: 8196 - protein, 107 aa, Artificial Sequence
  Description of Artificial Sequence: Synthetic polypeptide
EIVMTQSPATLSMSPGERATLSCRASQSVSRNLAWYQQKVGQAPRLLISGASTRATGIPARFSGSGSGTEFTLTINSLQSEDFAVYYCQQSNDWPLTFGQGTRLEIK

SEQ ID NO: 8197 - protein, 107 aa, Artificial Sequence
  Description of Artificial Sequence: Synthetic polypeptide
EIVMTQSPATLSVSPGERATLSCRASQSVSRNLAWYQQKPGQAPRLLIYGASTRATGIPARFSGSGSGTEFTLTISSLQSEDFAVYYCQQSNDWPLTFGQGTRLEIK

SEQ ID NO: 8198 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGQGTRLEIK

SEQ ID NO: 8199 - protein, 107 aa, Artificial Sequence; identical to SEQ ID NO: 8198
  Description of Artificial Sequence: Synthetic polypeptide

SEQ ID NO: 8200 - protein, 107 aa, Artificial Sequence; identical to SEQ ID NO: 8188
  Description of Artificial Sequence: Synthetic polypeptide

SEQ ID NO: 8201 - protein, 107 aa, Artificial Sequence
  Description of Artificial Sequence: Synthetic polypeptide
EIVLTQSPATLSLSPGERATLSCRASQSVSSYLAWYQQKPGQAPRLLIYVASNRATGIPARFSGSGSGTDFTLTISSLEPDDFAVYYCQQRYYWPLTFGGGTKVEIK

SEQ ID NO: 8202 - protein, 107 aa, Artificial Sequence
  Description of Artificial Sequence: Synthetic polypeptide
EIVLTQSPATLSLSPGERATLSCRASQSVSSYLAWYQQKPGQAPRLLIYVASNRATGIPARFSGSGSGTDFTLTISSLEPEDFAVYYCQQRYYWPLTFGGGTKVEIK

SEQ ID NO: 8203 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 8204 - protein, 107 aa, Artificial Sequence; identical to SEQ ID NO: 8203
  Description of Artificial Sequence: Synthetic polypeptide

SEQ ID NO: 8205 - protein, 107 aa, Artificial Sequence
  Description of Artificial Sequence: Synthetic polypeptide
DIVLTQSPATLSLSPGERATLSCRASQSVSSYLAWYQQKPGQAPRLLICDASHRATRIPARFSGSGSGTDFTLTISSLEPEDFAVYYCQQRSNWPITFGQGTRLEIK

SEQ ID NO: 8206 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 8207 - protein, 107 aa, Artificial Sequence
  Description of Artificial Sequence: Synthetic polypeptide
EIVLTQSPATLALSPGERATLSCRASQSVSKYLAWYQQKPGQAPRLLIYDASKRVTGIPGRLSGSGSGTDFTLTISSLEPEDFALYYCQQSSNWPITFGQGTRVEIK

SEQ ID NO: 8208 - protein, 107 aa, Artificial Sequence
  Description of Artificial Sequence: Synthetic polypeptide
EIVLTQSPATLSLSPGERATLSCRASQSVSKYLAWYQQKPGQAPRLLIYDASNRATGIPARFSGSGSGTDFTLTISSLEPEDFAVYYCQQSSNWPITFGQGTRLEIK

SEQ ID NO: 8209 - protein, 107 aa, Artificial Sequence
  Description of Artificial Sequence: Synthetic polypeptide
EIVLTQSPATLSLSPGERATLSCWASQSISRYLVWYQQKCGQAPRLLIYEASKRATGIPVRFSGSGSGTDFTLTISSLESEDFAVYYCQQRFNWPLTFGGGTKVEIK

SEQ ID NO: 8210 - protein, 106 aa, Artificial Sequence
  Description of Artificial Sequence: Synthetic polypeptide
EIVVTQSPATLSLSPGERATLSCRTSQTTTSYLAWYRQKPGQAPRLLIYDASNRAAGIPARFSGSGSGTDFTLTINSLEPEDFAVYYCQLRTNWITFGQGTRLEIK

SEQ ID NO: 8211 - protein, 107 aa, Artificial Sequence
  Description of Artificial Sequence: Synthetic polypeptide
EIVLTQSPATLSLSPGERATLSCRASQSISRYLAWYQQKPGQAPRLLIYEASNRATGIPARFSGSGSGTDFTLTISSLEPEDFAVYYCQQRFNWPLTFGGGTKVEIK

SEQ ID NO: 8212 - protein, 107 aa, Artificial Sequence
  Description of Artificial Sequence: Synthetic polypeptide
EIVMTQSPATLSVSPGERATLSCRASQSVSSKLAWYQQKPGQAPRLLIYGASTRATGIPARFSGSGSGTEFTLTISSLQSEDFAVYYCQQYNNWPITFGQGTRLEIK

SEQ ID NO: 8213 - protein, 107 aa, Artificial Sequence; identical to SEQ ID NO: 8212
  Description of Artificial Sequence: Synthetic polypeptide

SEQ ID NO: 8214 - protein, 106 aa, Artificial Sequence
  Description of Artificial Sequence: Synthetic polypeptide
EIVLTQSPATLSLSPGERATLSCRASQTTTSYLAWYQQKPGQAPRLLIYDASNRATGIPARFSGSGSGTDFTLTISSLEPEDFAVYYCQLRTNWITFGQGTRLEIK

SEQ ID NO: 8215 - protein, 107 aa, Artificial Sequence
  Description of Artificial Sequence: Synthetic polypeptide
EIVLTQSPATLSLSPGERAALSCRASQSVSNYLAWYQQKPGQAPRLLIYDASNRATGIPARFSGSGSGTDFTLTISSLEPEDFAVYYCQQRSNWPLTFGGGTKVEIR

SEQ ID NO: 8216 - protein, 107 aa, Artificial Sequence
  Description of Artificial Sequence: Synthetic polypeptide
EIVLTQSPATLSLSPGERATLSCRASQSVSNYLAWYQQKPGQAPRLLIYDASNRATGIPARFSGSGSGTDFTLTISSLEPEDFAVYYCQQRSNWPLTFGGGTKVEIK

SEQ ID NO: 8217 - protein, 107 aa, Artificial Sequence
  Description of Artificial Sequence: Synthetic polypeptide
EIVLTQSPATLSLSPGERATLSCRASQSVSRYLAWYQQKPGQAPRLLIHDASNRATGIPARFSGSGSGTDFTLTITSLEPEDFVVYYCQQRSDWPITFGQGTRLEIK

SEQ ID NO: 8218 - protein, 107 aa, Artificial Sequence
  Description of Artificial Sequence: Synthetic polypeptide
EIVLTQSPATLSLSPGERATLSCRASQSVSRYLAWYQQKPGQAPRLLIYDASNRATGIPARFSGSGSGTDFTLTISSLEPEDFAVYYCQQRSDWPITFGQGTRLEIK

SEQ ID NO: 8219 - protein, 107 aa, Artificial Sequence; identical to SEQ ID NO: 8206
  Description of Artificial Sequence: Synthetic polypeptide

SEQ ID NO: 8220 - protein, 125 aa, Artificial Sequence; identical to SEQ ID NO: 7525
  Description of Artificial Sequence: Synthetic polypeptide

SEQ ID NO: 8221 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIK

SEQ ID NO: 8222 - protein, 107 aa, Artificial Sequence; identical to SEQ ID NO: 8206
  Description of Artificial Sequence: Synthetic polypeptide

SEQ ID NO: 8223 - protein, 103 aa, Artificial Sequence
  Description of Artificial Sequence: Synthetic polypeptide
NPVTLGTSASISCRSSKSLLHSNGITYLYWYLQKPGQSPQLLIYQMSNLVSGVPDRFSSSGSGTDFTLRISRVEAEDVGVYYCAQNLELPYTFGGGTKLEIKR

SEQ ID NO: 8224 - protein, 115 aa, Artificial Sequence; identical to SEQ ID NO: 7847
  Description of Artificial Sequence: Synthetic polypeptide

SEQ ID NO: 8225 - protein, 115 aa, Artificial Sequence; identical to SEQ ID NO: 7847
  Description of Artificial Sequence: Synthetic polypeptide

SEQ ID NO: 8226 - protein, 107 aa, Artificial Sequence
  Description of Artificial Sequence: Synthetic polypeptide
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKR

SEQ ID NO: 8227 - protein, 107 aa, Artificial Sequence; identical to SEQ ID NO: 8183
  Description of Artificial Sequence: Synthetic polypeptide

SEQ ID NO: 8228 - protein, 127 aa, Artificial Sequence
  Description of Artificial Sequence: Synthetic polypeptide
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 8229 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 8230 - protein, 106 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSVFTFGPGTKVDIK

SEQ ID NO: 8231 - protein, 107 aa, Artificial Sequence; identical to SEQ ID NO: 8221
  Description of Artificial Sequence: Synthetic polypeptide

SEQ ID NO: 8232 - protein, 125 aa, Artificial Sequence; identical to SEQ ID NO: 7525
  Description of Artificial Sequence: Synthetic polypeptide

SEQ ID NO: 8233 - protein, 106 aa, Artificial Sequence; identical to SEQ ID NO: 5456
  Description of Artificial Sequence: Synthetic polypeptide

SEQ ID NO: 8234 - protein, 107 aa, Artificial Sequence; identical to SEQ ID NO: 8187
  Description of Artificial Sequence: Synthetic polypeptide

SEQ ID NO: 8235 - protein, 107 aa, Artificial Sequence; identical to SEQ ID NO: 8188
  Description of Artificial Sequence: Synthetic polypeptide

SEQ ID NO: 8236 - protein, 107 aa, Artificial Sequence; identical to SEQ ID NO: 8187
  Description of Artificial Sequence: Synthetic polypeptide

SEQ ID NO: 8237 - protein, 107 aa, Artificial Sequence; identical to SEQ ID NO: 8189
  Description of Artificial Sequence: Synthetic polypeptide

SEQ ID NO: 8238 - protein, 107 aa, Artificial Sequence; identical to SEQ ID NO: 8189
  Description of Artificial Sequence: Synthetic polypeptide

SEQ ID NO: 8239 - protein, 107 aa, Artificial Sequence; identical to SEQ ID NO: 8189
  Description of Artificial Sequence: Synthetic polypeptide

SEQ ID NO: 8240 - protein, 107 aa, Artificial Sequence; identical to SEQ ID NO: 8189
  Description of Artificial Sequence: Synthetic polypeptide

SEQ ID NO: 8241 - protein, 107 aa, Artificial Sequence; identical to SEQ ID NO: 8192
  Description of Artificial Sequence: Synthetic polypeptide

SEQ ID NO: 8242 - protein, 107 aa, Artificial Sequence; identical to SEQ ID NO: 8192
  Description of Artificial Sequence: Synthetic polypeptide

SEQ ID NO: 8243 - protein, 107 aa, Artificial Sequence; identical to SEQ ID NO: 8193
  Description of Artificial Sequence: Synthetic polypeptide

SEQ ID NO: 8244 - protein, 107 aa, Artificial Sequence; identical to SEQ ID NO: 8194
  Description of Artificial Sequence: Synthetic polypeptide

SEQ ID NO: 8245 - protein, 107 aa, Artificial Sequence; identical to SEQ ID NO: 8194
  Description of Artificial Sequence: Synthetic polypeptide

SEQ ID NO: 8246 - protein, 107 aa, Artificial Sequence; identical to SEQ ID NO: 8195
  Description of Artificial Sequence: Synthetic polypeptide

SEQ ID NO: 8247 - protein, 107 aa, Artificial Sequence; identical to SEQ ID NO: 8196
  Description of Artificial Sequence: Synthetic polypeptide

SEQ ID NO: 8248 - protein, 107 aa, Artificial Sequence; identical to SEQ ID NO: 8188
  Description of Artificial Sequence: Synthetic polypeptide

SEQ ID NO: 8249 - protein, 107 aa, Artificial Sequence
  Description of Artificial Sequence: Synthetic polypeptide
EIVMTQSPATLSVSPGERATLSCRASQSVSRNLAWYQQKVGQAPRLLISGASTRATGIPARFSGSGSGTEFTLTINSLQSEDFAVYYCQQSNDWPLTFGQGTRLEIK

SEQ ID NO: 8250 - protein, 107 aa, Artificial Sequence; identical to SEQ ID NO: 8197
  Description of Artificial Sequence: Synthetic polypeptide

SEQ ID NO: 8251 - protein, 107 aa, Artificial Sequence; identical to SEQ ID NO: 8198
  Description of Artificial Sequence: Synthetic polypeptide

SEQ ID NO: 8252 - protein, 107 aa, Artificial Sequence; identical to SEQ ID NO: 8198
  Description of Artificial Sequence: Synthetic polypeptide

SEQ ID NO: 8253 - protein, 107 aa, Artificial Sequence; identical to SEQ ID NO: 8198
  Description of Artificial Sequence: Synthetic polypeptide

SEQ ID NO: 8254 - protein, 107 aa, Artificial Sequence; identical to SEQ ID NO: 8188
  Description of Artificial Sequence: Synthetic polypeptide

SEQ ID NO: 8255 - protein, 107 aa, Artificial Sequence; identical to SEQ ID NO: 8201
  Description of Artificial Sequence: Synthetic polypeptide

SEQ ID NO: 8256 - protein, 107 aa, Artificial Sequence; identical to SEQ ID NO: 8201
  Description of Artificial Sequence: Synthetic polypeptide

SEQ ID NO: 8257 - protein, 107 aa, Artificial Sequence; identical to SEQ ID NO: 8202
  Description of Artificial Sequence: Synthetic polypeptide

SEQ ID NO: 8258 - protein, 107 aa, Artificial Sequence; identical to SEQ ID NO: 8203
  Description of Artificial Sequence: Synthetic polypeptide

SEQ ID NO: 8259 - protein, 107 aa, Artificial Sequence; identical to SEQ ID NO: 8203
  Description of Artificial Sequence: Synthetic polypeptide

SEQ ID NO: 8260 - protein, 107 aa, Artificial Sequence; identical to SEQ ID NO: 8203
  Description of Artificial Sequence: Synthetic polypeptide

SEQ ID NO: 8261 - protein, 107 aa, Artificial Sequence; identical to SEQ ID NO: 8205
  Description of Artificial Sequence: Synthetic polypeptide

SEQ ID NO: 8262 - protein, 107 aa, Artificial Sequence
  Description of Artificial Sequence: Synthetic polypeptide
EIVLTQSPATLSLSPGERATLSCRASQSVSSYLAWYQQKPGQAPRLLICDASHRATRIPARFSGSGSGTDFTLTISSLEPEDFAVYYCQQRSNWPITFGQGTRLEIK

SEQ ID NO: 8263 - protein, 107 aa, Artificial Sequence; identical to SEQ ID NO: 8206
  Description of Artificial Sequence: Synthetic polypeptide

SEQ ID NO: 8264 - protein, 107 aa, Artificial Sequence; identical to SEQ ID NO: 8207
  Description of Artificial Sequence: Synthetic polypeptide

SEQ ID NO: 8265 - protein, 107 aa, Artificial Sequence
  Description of Artificial Sequence: Synthetic polypeptide
EIVLTQSPATLSLSPGERATLSCRASQSVSKYLAWYQQKPGQAPRLLIYDASKRVTGIPGRLSGSGSGTDFTLTISSLEPEDFALYYCQQSSNWPITFGQGTRLEIK

SEQ ID NO: 8266 - protein, 107 aa, Artificial Sequence; identical to SEQ ID NO: 8208
  Description of Artificial Sequence: Synthetic polypeptide

SEQ ID NO: 8267 - protein, 107 aa, Artificial Sequence; identical to SEQ ID NO: 8209
  Description of Artificial Sequence: Synthetic polypeptide

SEQ ID NO: 8268 - protein, 106 aa, Artificial Sequence; identical to SEQ ID NO: 8210
  Description of Artificial Sequence: Synthetic polypeptide

SEQ ID NO: 8269 - protein, 107 aa, Artificial Sequence; identical to SEQ ID NO: 8209
  Description of Artificial Sequence: Synthetic polypeptide

SEQ ID NO: 8270 - protein, 107 aa, Artificial Sequence; identical to SEQ ID NO: 8211
  Description of Artificial Sequence: Synthetic polypeptide

SEQ ID NO: 8271 - protein, 107 aa, Artificial Sequence; identical to SEQ ID NO: 8212
  Description of Artificial Sequence: Synthetic polypeptide

SEQ ID NO: 8272 - protein, 107 aa, Artificial Sequence; identical to SEQ ID NO: 8212
  Description of Artificial Sequence: Synthetic polypeptide

SEQ ID NO: 8273 - protein, 107 aa, Artificial Sequence; identical to SEQ ID NO: 8212
  Description of Artificial Sequence: Synthetic polypeptide

SEQ ID NO: 8274 - protein, 106 aa, Artificial Sequence
  Description of Artificial Sequence: Synthetic polypeptide
EIVLTQSPATLSLSPGERATLSCRTSQTTTSYLAWYRQKPGQAPRLLIYDASNRAAGIPARFSGSGSGTDFTLTINSLEPEDFAVYYCQLRTNWITFGQGTRLEIK

SEQ ID NO: 8275 - protein, 106 aa, Artificial Sequence; identical to SEQ ID NO: 8214
  Description of Artificial Sequence: Synthetic polypeptide

SEQ ID NO: 8276 - protein, 107 aa, Artificial Sequence; identical to SEQ ID NO: 8215
  Description of Artificial Sequence: Synthetic polypeptide

SEQ ID NO: 8277 - protein, 107 aa, Artificial Sequence
  Description of Artificial Sequence: Synthetic polypeptide
EIVLTQSPATLSLSPGERAALSCRASQSVSNYLAWYQQKPGQAPRLLIYDASNRATGIPARFSGSGSGTDFTLTISSLEPEDFAVYYCQQRSNWPLTFGGGTKVEIK

SEQ ID NO: 8278 - protein, 107 aa, Artificial Sequence; identical to SEQ ID NO: 8216
  Description of Artificial Sequence: Synthetic polypeptide

SEQ ID NO: 8279 - protein, 107 aa, Artificial Sequence; identical to SEQ ID NO: 8217
  Description of Artificial Sequence: Synthetic polypeptide

SEQ ID NO: 8280 - protein, 107 aa, Artificial Sequence; identical to SEQ ID NO: 8217
  Description of Artificial Sequence: Synthetic polypeptide

SEQ ID NO: 8281 - protein, 107 aa, Artificial Sequence; identical to SEQ ID NO: 8218
  Description of Artificial Sequence: Synthetic polypeptide

SEQ ID NO: 8282 - protein, 106 aa, Artificial Sequence
  Description of Artificial Sequence: Synthetic polypeptide
DVVMTQSPAFLSVTPGEKVTITCRASSSVSYIHWFQQKPGKAPKSLIYATSNLASGVPSRFSGSGSGTDFTLTINSLEAEDAATYYCQQWTSNPPTFGGGTKVEIK

SEQ ID NO: 8283 - protein, 106 aa, Artificial Sequence
  Description of Artificial Sequence: Synthetic polypeptide
DVVMTQSPAFLSVTPGEKVTITCRASSSVSYIHWFQQKPGKAPKPLIYATSNLASGVPSRFSGSGSGTDFTLTINSLEAEDAATYYCQQWTSNPPTFGGGTKVEIK

SEQ ID NO: 8284 - protein, 106 aa, Artificial Sequence
  Description of Artificial Sequence: Synthetic polypeptide
DVVMTQSPAFLSVTPGEKVTITCRASSSVSYIHWFQQKPGKAPKPLIYATSNLASGVPSRFSGSGSGTDFTLTINSLEAEDAATYYCQQWTSKPPTFGGGTKVEIK

SEQ ID NO: 8285 - protein, 106 aa, Artificial Sequence
  Description of Artificial Sequence: Synthetic polypeptide
DIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIK

SEQ ID NO: 8286 - protein, 121 aa, Artificial Sequence
  Description of Artificial Sequence: Synthetic polypeptide
QVQLQQPGAELKKPGASVKVSCKASGYTFTSYNMHWVKQTPGRGLEWIGAIYPGNGDTSYNQKFKGKTTLTADKSSSTAYMELSSLRSEDTAVYYCARSTYYGGDWYFNVWGAGTTVTVSA

SEQ ID NO: 8287 - protein, 106 aa, Artificial Sequence
  Description of Artificial Sequence: Synthetic polypeptide
QIVLSQSPAIITASPGEKVTMTCRASTSASYIHWFQQKPTSSPKPWIYATSNLASGVPSRFSGSGSGTTYSMTISSLEAEDAATYYCQQWTSNPPTFGGGTKLEIK

SEQ ID NO: 8288 - protein, 106 aa, Artificial Sequence
  Description of Artificial Sequence: Synthetic polypeptide
QIVLSQSPAIITASPGEKVTMTCRASTSVSYIHWFQQKPGSSPKPWIYATSNLASGVPSRFSGSGSGTTYSMTISSLEAEDAATYYCQQWTSNPPTFGGGTKLEIK

SEQ ID NO: 8289 - protein, 106 aa, Artificial Sequence [sequence omitted]

SEQ ID NO: 8290 - protein, 213 aa, Artificial Sequence; identical to SEQ ID NO: 7530
  Description of Artificial Sequence: Synthetic polypeptide

SEQ ID NO: 8291 - protein, 213 aa, Artificial Sequence; identical to SEQ ID NO: 7947
  Description of Artificial Sequence: Synthetic polypeptide

SEQ ID NO: 8292 - protein, 107 aa, Artificial Sequence
  Description of Artificial Sequence: Synthetic polypeptide
DIQMTQSPSSLSASVGDRVTITCRASSSVSYLHWYQQKPGKAPKPLIYAPSNLASGVPSRFSGSGSGTDFTLTISSLQPEDFATYYCQQWAFNPPTFGQGTKVEIKR

SEQ ID NO: 8293 - protein, 107 aa, Artificial Sequence; identical to SEQ ID NO: 8183
  Description of Artificial Sequence: Synthetic polypeptide

SEQ ID NO: 8294 - protein, 107 aa, Artificial Sequence; identical to SEQ ID NO: 8187
  Description of Artificial Sequence: Synthetic polypeptide

SEQ ID NO: 8295 - protein, 107 aa, Artificial Sequence; identical to SEQ ID NO: 8189
  Description of Artificial Sequence: Synthetic polypeptide

SEQ ID NO: 8296 - protein, 107 aa, Artificial Sequence; identical to SEQ ID NO: 8192
  Description of Artificial Sequence: Synthetic polypeptide

SEQ ID NO: 8297 - protein, 107 aa, Artificial Sequence; identical to SEQ ID NO: 8194
  Description of Artificial Sequence: Synthetic polypeptide

SEQ ID NO: 8298 - protein, 107 aa, Artificial Sequence; identical to SEQ ID NO: 8188
  Description of Artificial Sequence: Synthetic polypeptide

SEQ ID NO: 8299 - protein, 107 aa, Artificial Sequence; identical to SEQ ID NO: 8249
  Description of Artificial Sequence: Synthetic polypeptide

SEQ ID NO: 8300 - protein, 107 aa, Artificial Sequence; identical to SEQ ID NO: 8198
  Description of Artificial Sequence: Synthetic polypeptide

SEQ ID NO: 8301 - protein, 107 aa, Artificial Sequence; identical to SEQ ID NO: 8201
  Description of Artificial Sequence: Synthetic polypeptide

SEQ ID NO: 8302 - protein, 107 aa, Artificial Sequence; identical to SEQ ID NO: 8203
  Description of Artificial Sequence: Synthetic polypeptide

SEQ ID NO: 8303 - protein, 107 aa, Artificial Sequence; identical to SEQ ID NO: 8262
  Description of Artificial Sequence: Synthetic polypeptide

SEQ ID NO: 8304 - protein, 107 aa, Artificial Sequence; identical to SEQ ID NO: 8265
  Description of Artificial Sequence: Synthetic polypeptide

SEQ ID NO: 8305 - protein, 107 aa, Artificial Sequence; identical to SEQ ID NO: 8209
  Description of Artificial Sequence: Synthetic polypeptide

SEQ ID NO: 8306 - protein, 107 aa, Artificial Sequence; identical to SEQ ID NO: 8212
  Description of Artificial Sequence: Synthetic polypeptide

SEQ ID NO: 8307 - protein, 106 aa, Artificial Sequence; identical to SEQ ID NO: 8274
  Description of Artificial Sequence: Synthetic polypeptide

SEQ ID NO: 8308 - protein, 107 aa, Artificial Sequence; identical to SEQ ID NO: 8277
  Description of Artificial Sequence: Synthetic polypeptide

SEQ ID NO: 8309 - protein, 107 aa, Artificial Sequence; identical to SEQ ID NO: 8217
  Description of Artificial Sequence: Synthetic polypeptide

SEQ ID NO: 8310 - protein, 112 aa, Artificial Sequence
  Description of Artificial Sequence: Synthetic polypeptide
DIVMTQTPLSSPVTLGQPASISCRSRQSLLHSDGNTYLSWLQQRPGQPPRLLIYKLSNRVSGVPDRFSGSGAGTDFTLKISRVEAEDVGVYYCMQSTQFPLTFGGGTKVKIK

SEQ ID NO: 8311 - protein, 112 aa, Artificial Sequence
  Description of Artificial Sequence: Synthetic polypeptide
DIVMTQTPLSSPVTLGQPASISCRSSQSLVHSDRNTYLSWLQQRPGQPPRLLIYKVSNRFSGVPERFSGSGTGTDFTLKISRVEAEDVGVYYCVQETLFPITIGQGTRLEIK

SEQ ID NO: 8312 - protein, 112 aa, Artificial Sequence
  Description of Artificial Sequence: Synthetic polypeptide
DIVMTQTPLSSPVTLGQPASISCRSSQSLVHSDGNTFLSWLQQRPGQPPRLLIYKISNRFSGVPDRFSGSGAGTDFTLKISRVEAEDVGIYYCMQATQFPLTFGGGTKVEIK

SEQ ID NO: 8313 - protein, 112 aa, Artificial Sequence
  Description of Artificial Sequence: Synthetic polypeptide
DIVLTQTPLSSPVTLGQPASISCRSSQSLVHSDGHTYLSWLQQRPGQPPRLLIYKISNRFSGVPDRFSGSGAGTDFTLKISRVGAEDVGVYYCMQATQFPLTFGGGTKVEIK

SEQ ID NO: 8314 - protein, 112 aa, Artificial Sequence
  Description of Artificial Sequence: Synthetic polypeptide
DIVMTQTPLSSPVTLGQPASISCRSSQSLVSSDGNTYLSWLQQRPGQPPRLLIYKISNLFSGVPDRFSGSGAGTDFTLKISRVEAEDVGLYYCMQATQFPLTFGGGTKVEIK

SEQ ID NO: 8315 - protein, 112 aa, Artificial Sequence
  Description of Artificial Sequence: Synthetic polypeptide
DIVMTQTPLSSPVTLGQPASISCRSSQRLVHSDGHTYLSWLQQRPGQPPRLLISKVSNRFSGVPDRFSGSGAGTDFTLKISRVEAEDVGIYYCMQATQFPLTFGGGTKVEIK

SEQ ID NO: 8316 - protein, 112 aa, Artificial Sequence
  Description of Artificial Sequence: Synthetic polypeptide
DIVMTQSPLSSPVTLGQPASISCRSSQSLVHSDGNTFLSWLQQRPGQPPRLLIYKISNRFSGVPDRFSGSGAGTDFTLKISRVEAEDVGVYYCIQATQFPLTFGGGTKVEIK

SEQ ID NO: 8317 - protein, 113 aa, Artificial Sequence
  Description of Artificial Sequence: Synthetic polypeptide
DVVMTQSPLSLPVTLGQPASISCRSRQSLVYSDGSTYLNWFQQRPGQSPRRLIYKVSNWDSGVPDRFSASGSGTDFTLKISRVEAEDDGVYHCMQGTHWPLLAFGGGTKVEIK

SEQ ID NO: 8318 - protein, 112 aa, Artificial Sequence
  Description of Artificial Sequence: Synthetic polypeptide
DIVMTQTPLSSPVTLGQPASISCRSSQSLVHSDGNTFLSWLQQRPGQPPRLLIYKISNRFSGVPDRFSGSGAGTDFTLKISRVEAEDVGVYYCMQATQFPLTFGGGTKVEIK

SEQ ID NO: 8319 - protein, 112 aa, Artificial Sequence
  Description of Artificial Sequence: Synthetic polypeptide
DIVMTQTPLSSPVTLGQPASISCRSSQSLVHSDGHTYLSWLQQRPGQPPRLLFYKISNRFSGVPDRFSGSGAGTDFTLKISRVEAEDVGIYYCMQATQFPLTFGGGTKVDIK

SEQ ID NO: 8320 - protein, 115 aa, Artificial Sequence
  Description of Artificial Sequence: Synthetic polypeptide
QPVLTQPTSLSASPGASARLTCTLRSGINLGSYRIFWYQQKPESPPRYLLSYYSDSRKHQGSGVPSRFSGSKDASSNAGILVISGLQSEDEADYYCIFWHSSAWVFGGGTKLTVL

SEQ ID NO: 8321 - protein, 112 aa, Artificial Sequence
  Description of Artificial Sequence: Synthetic polypeptide
DIVMTQTPLSSPVTLGQPASISCRSSQSLVYSDGNTYLSWLQQRPGQPPRLLFYKISNRFSGVPDRFSGSGAGTDFTLKISRVEAEDVGVYYCVQATQFPLTFGGGTKVEIK

SEQ ID NO: 8322 - protein, 112 aa, Artificial Sequence
  Description of Artificial Sequence: Synthetic polypeptide
DVVMTQSPLSLSVTLGQPASISCRSSQSLVYNDGDTYLNWFQQRPGQSPRLLIYKVSNWDSGVPDRFSGSGSGTDFTLKVSRVEAEDVGVYYCMQGTHWPLTFGGGTKVEIK

SEQ ID NO: 8323 - protein, 112 aa, Artificial Sequence
  Description of Artificial Sequence: Synthetic polypeptide
DIVMTQTPLSSPVTLGQPASISCRSSQSLVHSDGKTYLSWLQQRPGQPPRLLIYKSSNRFSGVPDRFSGSGAGTDFTLKISRVEAEDVGVYYCVQATQFPITFGQGTRLEIK

SEQ ID NO: 8324 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQAIQFPITFGQGTRLEIK

SEQ ID NO: 8325 - protein, 112 aa, Artificial Sequence
  Description of Artificial Sequence: Synthetic polypeptide
DIVMTQTPLSSPVTLGQPASISCRSSQSLVYSDGNTYLSWLQQRPGQPPRLLIYKISNRFSGVPDRFSGSGAGTDFTLKISRVEAEDVGVYYCVQATQFPLTFGGGTKVEIK

SEQ ID NO: 8326 - protein, 110 aa, Artificial Sequence
  Description of Artificial Sequence: Synthetic polypeptide
DVVMTQSPLSLPVTLGQPASISCRSSQSLVYSDGNAYLNWFQQRPGQSPRRLIYKVSNWDSGVPDRFSGSGSGTDFTLKIRRVEAEDVGAYYCMQGIHCTFGPGTKVHIK

SEQ ID NO: 8327 - protein, 112 aa, Artificial Sequence; identical to SEQ ID NO: 8325
  Description of Artificial Sequence: Synthetic polypeptide

SEQ ID NO: 8328 - protein, 112 aa, Artificial Sequence
  Description of Artificial Sequence: Synthetic polypeptide
DIVMTQTPLSSPVTLGQPASISCRSSQSLVHSDGNTFLSWLQQRPGQPPRLLIYKISNRFSGVPDRFSGSGAGTDFTLKISRVEAEDVGVYYCMQLTQFPLTFGGGTKVEIR

SEQ ID NO: 8329 - protein, 113 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPSITFGQGTRLEIK

SEQ ID NO: 8330 - protein, 112 aa, Artificial Sequence
  Description of Artificial Sequence: Synthetic polypeptide
DIVMTQTPHSSPVTLGQPASISCRSSQSLVSRDGNTYLSWLQQRPGQPPRLLIYKISNRFSGVPNRFSGSGAGTDFTLKISRVKAEDVGVYYCMQATQFPLTFGQGTRLEIK

SEQ ID NO: 8331 - protein, 112 aa, Artificial Sequence
  Description of Artificial Sequence: Synthetic polypeptide
DIVMTQTPLSSPVTLGQPASISCRSSQSLVSRDGNTYLSWLQQRPGQPPRLLIYKISNRFSGVPDRFSGSGAGTDFTLKISRVEVEDVGVYYCMQATQFPITFGQGTRLEIK

SEQ ID NO: 8332 - protein, 112 aa, Artificial Sequence
  Description of Artificial Sequence: Synthetic polypeptide
DIVMTQTPLSSPVTLGQPASISCRSSQSLVHSDGNTFLSWLQQRPGQPPRLLIYKISNRFSGVPDRFSGSGAGTDFTLKISRVEAEDVGVYYCMQGTQFPLTFGGGTKVEIK

SEQ ID NO: 8333 - protein, 112 aa, Artificial Sequence
  Description of Artificial Sequence: Synthetic polypeptide
DIVMTQSPLSSPVTLGQPASISCRYSQSLVHRDGNTYLSWLQQRPGQPPRLVIHKISNRFSGVPDRFSGSGAGTDFTLKISRVEAEDVGFYYCMQTTQFPLTFGGGTKVEIK

SEQ ID NO: 8334 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPLTFGGGTKVEIK

SEQ ID NO: 8335 - protein, 112 aa, Artificial Sequence
  Description of Artificial Sequence: Synthetic polypeptide
EIVMTQTPLSSPVTLGQPASISCKSSQSLVHSDGNTYLSWLQQRPGQPPRLLIYKISNRFSGVPDRFSGSGAGTDFTLKISRVEAEDVGVYYCMQTTYFPLTFGGGTKVEIK

SEQ ID NO: 8336 - protein, 112 aa, Artificial Sequence
  Description of Artificial Sequence: Synthetic polypeptide
DIVMTQTPLSSPVTLGQPASISCRSSQSLVYSDGNTYLSWLHQRPGQPPRLLIYKISNRFSGVPDRFSGSGAGTDFTLKISRVEAEDVGLYYCMQTTQFPLTFGGGTKVKIK

SEQ ID NO: 8337 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKLSNRFSGIPDRFSGSGAGTDFTLKISRVEAEDVGVYYCMQATQFPLTFGGGTKVEIK

SEQ ID NO: 8338 - protein, 107 aa, Artificial Sequence
  Description of Artificial Sequence: Synthetic polypeptide
EIVMTQSPATLSVSPGERATLSCRASQSVSSNLAWYQQKPGQAPRLLISGASTRATGIPARFSGSGSGTEFTLTISSLQSEDFAVYYCHQYNDWSLTFGGGTKVEIK

SEQ ID NO: 8339 - protein, 112 aa, Artificial Sequence
  Description of Artificial Sequence: Synthetic polypeptide
DIVMTQTPLSSPVTLGQPASISCRSSQSLVYRDGNTYLSWLQQRPGQPPRLLIYKISNRFSGVPDRFSGSGAGTDFTLKISRVEAEDVGVYYCMQATQFPLTFGGGTKVEIK

SEQ ID NO: 8340 - protein, 112 aa, Artificial Sequence
  Description of Artificial Sequence: Synthetic polypeptide
KIVMTQTPLSSPVTLGQPASISCRSSQSLVHSDGNTYLSWFQQRPGQPPRLLINKISNRFSGVPDRFSGSGAGTDFTLKISRVEAEDVGVYYCMQATQFPLTFGGGTKVEIK

SEQ ID NO: 8341 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPARFSGSDSGNTASLTITGAQAEDEADYYCNSRDSSGNHVVFGGGTKLTVL

SEQ ID NO: 8342 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLLYKNSNRFSGVPDRFSGSGAGTDFTLKISRVEAEDVGVYYCMQATQFPLTFGGGTKVEIK

SEQ ID NO: 8343 - protein, 112 aa, Artificial Sequence
  Description of Artificial Sequence: Synthetic polypeptide
DIVMTQTPPSSPVTRGQPASISCRSSQSLVHSDGKTYLSWLQQRPGQPPRLLIYKISNRFSGVPGRFSGSGAGTDFTLKISRVEAEDVGVYYCMQATQFPLTFGGGTKVEIK

SEQ ID NO: 8344 - protein, 125 aa, Artificial Sequence; identical to SEQ ID NO: 7525
  Description of Artificial Sequence: Synthetic polypeptide

SEQ ID NO: 8345 - protein, 135 aa, Artificial Sequence
  Description of Artificial Sequence: Synthetic polypeptide
MESQTQVFVFLLLCVSGAHGSIVMTQTPKFLLVSAGDRITLTCKASQSVTNDVAWYQQKPGQSPKLLIYYASNRYTGVPDRFTGSGYGTDFTFTISTVQAEDLAVYFCQQDYRSPWTFGGGTKLEIKRADAAPTV

SEQ ID NO: 8346 - protein, 135 aa, Artificial Sequence
  Description of Artificial Sequence: Synthetic polypeptide
MESQTQVFVFLLLCVSGAHGSIVMTQTPKFLLVSAGDRVTISCKASQSVSNDVAWYQQKPGQSPKLLIYYASKRYTGVPDRLTGSGYGTDFTFTISTVQAEDLAVYFCQQDHSYPWTFGGGTKLEIKRADAAPTV

SEQ ID NO: 8347 - protein, 135 aa, Artificial Sequence
  Description of Artificial Sequence: Synthetic polypeptide
MESQTQVFISILLWLYGADGNIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKRADAAPTV

SEQ ID NO: 8348 - protein, 106 aa, Artificial Sequence
  Description of Artificial Sequence: Synthetic polypeptide
SIVMTQTPKFLLVSAGDRITLTCKASQSVTNDVAWYQQKPGQSPKLLIYYASNRYTGVPDRFTGSGYGTDFTFTISTVQAEDLAVYFCQQDYRSPWTFGGGTKLEI

SEQ ID NO: 8349 - protein, 113 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLPPWASYTFGQGTKLEIKRT

SEQ ID NO: 8350 - protein, 113 aa, Artificial Sequence
  Description of Artificial Sequence: Synthetic polypeptide
DIVMTQSPSSLSASVGDRVTITCQASQDISNYLNWYQQKPGKAPKLLIYDASNLETGVPSRFSGSGSGTDFTLTISSLQPEDFATYYCQQYDNLPPWASYTFGGGTKVEIKRT

SEQ ID NO: 8351 - protein, 109 aa, Artificial Sequence
  Description of Artificial Sequence: Synthetic polypeptide
DIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRT

SEQ ID NO: 8352 - protein, 110 aa, Artificial Sequence
  Description of Artificial Sequence: Synthetic polypeptide
MDMRVPAQLLGLLQLWLSGARCDIVMTQSPSSLSASVGDRVTITCKASQSVTNDVAWYQQKPGKAPKLLIYYASNRYTGVPSRFSGSGSGTDFTLTISSLQPEDFATYYC

SEQ ID NO: 8353 - protein, 131 aa, Artificial Sequence
  Description of Artificial Sequence: Synthetic polypeptide
MDMRVPAQLLGLLQLWLSGARCDIVMTQSPSSLSASVGDRVTITCKASQSVTNDVAWYQQKPGKAPKLLIYYASNRYTGVPSRFSGSGSGTDFTLTISSLQPEDFATYFCQQDYRSPWTFGGGTKVEIKRT

SEQ ID NO: 8354 - protein, 131 aa, Artificial Sequence
  Description of Artificial Sequence: Synthetic polypeptide
MDMRVPAQLLGLLQLWLSGARCDIVMTQSPSSLSASVGDRVTITCKASQSVTNDVAWYQQKPGKAPKLLIYYASNRYTGVPDRFSGSGYGTDFTLTISSLQPEDFATYFCQQDYRSPWTFGGGTKVEIKRT

SEQ ID NO: 8355 - protein, 136 aa, Artificial Sequence
  Description of Artificial Sequence: Synthetic polypeptide
KLAATMKSQTQVFVFLLLCVSGAHGSIVMTQTPKFLLVSAGDRITLTCKASQSVTNDVAWYQQKPGQSPKLLIYYASNRYTGVPDRFTGSGYGTDFTFTISTVQAEDLAVYFCQQDYRSPWTFGGGTKLEIKREWI

SEQ ID NO: 8356 - protein, 122 aa, Artificial Sequence
  Description of Artificial Sequence: Synthetic polypeptide
QVQLEESGGGVVRPGRSLRLSCAASGFTFDQYAIHWIRQAPGKGLEWVTVISPVGNEQHYAASVKGRFTVSRNNSNNTLSLQMNSLTTEDTAVYYCVRGDVVTTVTTGYFDYWGQGVLVTVS

SEQ ID NO: 8357 - protein, 116 aa, Artificial Sequence
  Description of Artificial Sequence: Synthetic polypeptide
QVQLEESGGGVVRPGRSLRLSCAASGFTFDDYGVNWIRQAPGKGLEWVTIIWGDGRTDYNSALKSRFTVSRNNSNNTLSLQMNSLTTEDTAVYYCVRAPGNRAMEYWGQGVLVTVS

SEQ ID NO: 8358 - protein, 135 aa, Artificial Sequence
  Description of Artificial Sequence: Synthetic polypeptide
MEFGLSWVFLVALLRGVQCQVQLEESGGGVVRPGRSLRLSCAASGFTFDDYGVNWIRQAPGKGLEWVTIIWGDGRTDYNSALKSRFTVSRNNSNNTLSLQMNSLTTEDTAVYYCVRAPGNRAMEYWGQGVLVTVS

SEQ ID NO: 8359 - protein, 135 aa, Artificial Sequence
  Description of Artificial Sequence: Synthetic polypeptide
MEFGLSWVFLVALLRGVQCQVQLEESGGGVVRPGRSLRLSCAASGFTLSDYGVNWIRQAPGKGLEWVGIIWGDGRTDYNSALKSRLTVSRNNSNNTLSLQMNSLTTEDTAVYYCVRAPGNRAMEYWGQGVLVTVS

SEQ ID NO: 8360 - protein, 135 aa, Artificial Sequence
  Description of Artificial Sequence: Synthetic polypeptide
MDTLCSTLLLLTIPSWVLSQVQLEESGGGVVRPGRSLRLSCAASGFTLSDYGVNWIRQAPGKGLEWVGIIWGDGRTDYNSALKSRLTVSRNNSNNTLSLQMNSLTTEDTAVYYCVRAPGNRAMEYWGQGVLVTVS

SEQ ID NO: 8361 - protein, 135 aa, Artificial Sequence
  Description of Artificial Sequence: Synthetic polypeptide
MDTLCSTLLLLTIPSWVLSQVQLEESGGGVVRPGRSLRLSCAASGFTFSDYGVNWIRQAPGKGLEWVGIIWGDGRTDYNSALKSRLTVSRNNSNNTLSLQMNSLTTEDTAVYYCVRAPGNRAMEYWGQGVLVTVS

SEQ ID NO: 8362 - protein, 135 aa, Artificial Sequence
  Description of Artificial Sequence: Synthetic polypeptide
MDTLCSTLLLLTIPSWVLSQVQLEESGGGVVRPGRSLRLSCAASGFTLDDYGVNWIRQAPGKGLEWVGIIWGDGRTDYNSALKSRLTVSRNNSNNTLSLQMNSLTTEDTAVYYCVRAPGNRAMEYWGQGVLVTVS

SEQ ID NO: 8363 - protein, 135 aa, Artificial Sequence
  Description of Artificial Sequence: Synthetic polypeptide
MDTLCSTLLLLTIPSWVLSQVQLEESGGGVVRPGRSLRLSCAASGFTLSDYGVNWIRQAPGKGLEWVTIIWGDGRTDYNSALKSRLTVSRNNSNNTLSLQMNSLTTEDTAVYYCVRAPGNRAMEYWGQGVLVTVS

SEQ ID NO: 8364 - protein, 135 aa, Artificial Sequence
  Description of Artificial Sequence: Synthetic polypeptide
MDTLCSTLLLLTIPSWVLSQVQLEESGGGVVRPGRSLRLSCAASGFTLSDYGVNWIRQAPGKGLEWVGIIWGDGRTDYNSALKSRFTVSRNNSNNTLSLQMNSLTTEDTAVYYCVRAPGNRAMEYWGQGVLVTVS

SEQ ID NO: 8365 - protein, 135 aa, Artificial Sequence
  Description of Artificial Sequence: Synthetic polypeptide
MDTLCSTLLLLTIPSWVLSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVS

SEQ ID NO: 8366 - protein, 135 aa, Artificial Sequence
  Description of Artificial Sequence: Synthetic polypeptide
MDTLCSTLLLLTIPSWVLSQVQLEESGGGVVRPGRSLRLSCAASGFTFDDYGVNWIRQAPGKGLEWVTIIWGDGRTDYNSALKSRFTVSRNNSNNTLSLQMNSLTTEDTAVYYCVRAPGNRAMEYWGQGVLVTVS

SEQ ID NO: 8367 - protein, 113 aa, Artificial Sequence; identical to SEQ ID NO: 7599
  Description of Artificial Sequence: Synthetic polypeptide

SEQ ID NO: 8368 - protein, 113 aa, Artificial Sequence
  Description of Artificial Sequence: Synthetic polypeptide
DVVVTQTPLSLPVSFGDQVSISCRSSQSLANSYGNTFLSWYLHKPGQSPQLLIYGISNRFSGVPDRFTGSGSGTDFTLKISTIKPEDLGMYYCLQGTHQPYTFGGGTKLEIKR

SEQ ID NO: 8369 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIKR

SEQ ID NO: 8370 - protein, 107 aa, Artificial Sequence
  Description of Artificial Sequence: Synthetic polypeptide
DIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIK

SEQ ID NO: 8371 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISSLEPEDFAVYYCQQYGSSPWTFGQGTKVEIK

SEQ ID NO: 8372 - protein, 107 aa, Artificial Sequence
  Description of Artificial Sequence: Synthetic polypeptide
EIVLTQSPATLSLSPGERATLSCRASQSVSSNLAWYQQKPGQAPRLLIYDASNRATGIPARLSGSGSGTDFTLTISSLEPEDFAVYYCQQRSNWPWTFGQGTKVEIK

SEQ ID NO: 8373 - protein, 94 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSY

SEQ ID NO: 8374 - protein, 95 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSS

SEQ ID NO: 8375 - protein, 94 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNW

SEQ ID NO: 8376 - protein, 107 aa, Artificial Sequence; identical to SEQ ID NO: 8370
  Description of Artificial Sequence: Synthetic polypeptide

SEQ ID NO: 8377 - protein, 108 aa, Artificial Sequence; identical to SEQ ID NO: 8371
  Description of Artificial Sequence: Synthetic polypeptide

SEQ ID NO: 8378 - protein, 107 aa, Artificial Sequence; identical to SEQ ID NO: 8372
  Description of Artificial Sequence: Synthetic polypeptide

SEQ ID NO: 8379 - protein, 111 aa, Artificial Sequence
  Description of Artificial Sequence: Synthetic polypeptide
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIK

SEQ ID NO: 8380 - protein, 111 aa, Artificial Sequence
  Description of Artificial Sequence: Synthetic polypeptide
EIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIK

SEQ ID NO: 8381 - protein, 111 aa, Artificial Sequence; identical to SEQ ID NO: 5383
  Description of Artificial Sequence: Synthetic polypeptide

SEQ ID NO: 8382 - protein, 111 aa, Artificial Sequence; identical to SEQ ID NO: 8380
  Description of Artificial Sequence: Synthetic polypeptide

SEQ ID NO: 8383 - protein, 111 aa, Artificial Sequence
  Description of Artificial Sequence: Synthetic polypeptide
AIVLTQSPDSLAVSLGERATINCKASQSVDFDGDSYLNWYQQKPGQPPKVLIYAASTLETGVPSRFSGSGSGTDFTLTINSLEAEDAATYYCQQSNEDPWTFGGGTKVEIK

SEQ ID NO: 8384 - protein, 107 aa, Artificial Sequence; identical to SEQ ID NO: 8370
  Description of Artificial Sequence: Synthetic polypeptide

SEQ ID NO: 8385 - protein, 108 aa, Artificial Sequence; identical to SEQ ID NO: 8371
  Description of Artificial Sequence: Synthetic polypeptide

SEQ ID NO: 8386 - protein, 107 aa, Artificial Sequence; identical to SEQ ID NO: 8372
  Description of Artificial Sequence: Synthetic polypeptide

SEQ ID NO: 8387 - protein, 108 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFRGSGSGTDFTLTISSLQPEDFATYYCQQYNSYPYTFGQGTKLEIKR

SEQ ID NO: 8388 - protein, 108 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSRSGTDFTLTISSLQPEDFATYYCQQYNSYPYTFGQGTKLEIKR

SEQ ID NO: 8389 - protein, 108 aa, Artificial Sequence; identical to SEQ ID NO: 8388
  Description of Artificial Sequence: Synthetic polypeptide

SEQ ID NO: 8390 - protein, 108 aa, Artificial Sequence; identical to SEQ ID NO: 8388
  Description of Artificial Sequence: Synthetic polypeptide

SEQ ID NO: 8391 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSRTDFTLTISSLEPEDFAVYYCQQRSNWPHLTFGGGTKVEIKR

SEQ ID NO: 8392 - protein, 109 aa, Artificial Sequence
  Description of Artificial Sequence: Synthetic polypeptide
EIVLTQSPATLSLSPGERATLSCKASQSVSSSLAWYQQKPGQAPRLLIYDASNRATGIPARFSGSGSGTDFTLTISSLEPEDFAVYYCQQRSNWPPYTFGQGTKLEIKR

SEQ ID NO: 8393 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWGFTFGPGTKVDIKR

SEQ ID NO: 8394 - protein, 108 aa, Artificial Sequence
  Description of Artificial Sequence: Synthetic polypeptide
AVQLTQSPSSLSASVGDRVTITCRASQGISSALAWYQQKPGKAPKLLIYDASSLESGVPSRFSGSGSGTDFTLTISSLQPEDFATYCCQQFNSYPHTFGGGTKVEIKR

SEQ ID NO: 8395 - protein, 109 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSSWPPYTFGQGTKLEIKR

SEQ ID NO: 8396 - protein, 94 aa, Artificial Sequence; identical to SEQ ID NO: 8375
  Description of Artificial Sequence: Synthetic polypeptide

SEQ ID NO: 8397 - protein, 115 aa, Artificial Sequence
  Description of Artificial Sequence: Synthetic polypeptide
DIVLTQSPTIMSASPGERVTMTCTASSSVNYIHWYQQKSGDSPKRWIFDTSKVASGVPARFSGSGSGTSYSLTISTMEAEDAATYYCQQWRSYPLTFGDGTRLELKRADAAPTVS

SEQ ID NO: 8398 - protein, 115 aa, Artificial Sequence
  Description of Artificial Sequence: Synthetic polypeptide
DIVLTQSPAIMSASPGEKVTMTCSANSSVSYIHWYQQKSGTSPKRWIFDTSKLASGVPARFSGSGSGTSYSLTISTMEAEDAATYYCQQWTSHPLTFGTGTKLQLKRADAAPTVS

SEQ ID NO: 8399 - protein, 107 aa, Artificial Sequence
  Description of Artificial Sequence: Synthetic polypeptide
DIQLTQSPSSLSASVGDRVTITCRASQGISSALAWYQQKPGKAPKLLIYDASSLESGVPSRFSGSGSGTDFTLTISSLQPEDFATYYCQQFNSSITFGQGTKLEIKR

SEQ ID NO: 8400 - protein, 107 aa, Artificial Sequence
  Description of Artificial Sequence: Synthetic polypeptide
DIQLTQSPSSLSASVGDRVTITCRASQGISSALAWSQQKPGKAPKLLIYDASSLESGVPSRFSGSGSGTDFTLTISSLQPEDFATYYCQQFNSSITFGQGTKLEIKR

SEQ ID NO: 8401 - protein, 107 aa, Artificial Sequence
  Description of Artificial Sequence: Synthetic polypeptide
DIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKR

SEQ ID NO: 8402 - protein, 107 aa, Artificial Sequence
  Description of Artificial Sequence: Synthetic polypeptide
DIQLTQSPSSLSASVGDRVTITCRASQGISSVLAWYQQKPGKAPKLLIYDASSLESGVPSRFSGSGSGTDFTLTISSLQPEDFATYYCQQFDSSITFGQGTKLEIKR

SEQ ID NO: 8403 - protein, 107 aa, Artificial Sequence
  Description of Artificial Sequence: Synthetic polypeptide
DIQLTQSPSSLSASVGDRVTITCRASQGISSALAWYQQKPGKAPKLLIYDASRLESGVPSRFSGSGSGTDFTLTISSLQPEDFTTYYCQQFNSSYTFGQGTKLEIKR

SEQ ID NO: 8404 - protein, 107 aa, Artificial Sequence
  Description of Artificial Sequence: Synthetic polypeptide
DIQLTQSPSSLSASVGDRVTITCRASQGISSVLAWYQQKPGKAPKLLIYAASSLESGVPSRFSGSGSGTDFTLTISSLQPEDFATYYCQQFNSSITFGQGTKVEIKR

SEQ ID NO: 8405 - protein, 107 aa, Artificial Sequence
  Description of Artificial Sequence: Synthetic polypeptide
DIQLTQSPSSLSASVGDRVTITCRASQGISSVLAWYQQKPGKAPKLLIYAASSLESGVPSRFSGSGSGTDFTLTISSLQPEDFATYYCQQFDSSITFGQGTKVEIKR

SEQ ID NO: 8406 - protein, 107 aa, Artificial Sequence
  Description of Artificial Sequence: Synthetic polypeptide
DIQLTQSPSSLSASVGDRVTITCRASQGISSVLAWYQQKPGKAPKLLIYAASSLESGVPSRFSGSGSGTDFTLTISSLQPEDFATYYCQQFNSSITFGQGTKLEIKR

SEQ ID NO: 8407 - protein, 107 aa, Artificial Sequence
  Description of Artificial Sequence: Synthetic polypeptide
DIQLTQSPSSLSASVGDRVTITCRASQGISSALAWYQQKPGKAPKFMIYDASSLESGVPSRFSGSGSGTDFTLTISSLQPEDFATYYCQQFNSSITFGQGTKLEIKR

SEQ ID NO: 8408 - protein, 107 aa, Artificial Sequence; identical to SEQ ID NO: 8407
  Description of Artificial Sequence: Synthetic polypeptide

SEQ ID NO: 8409 - protein, 107 aa, Artificial Sequence; identical to SEQ ID NO: 8407
  Description of Artificial Sequence: Synthetic polypeptide

SEQ ID NO: 8410 - protein, 107 aa, Artificial Sequence; identical to SEQ ID NO: 8407
  Description of Artificial Sequence: Synthetic polypeptide

SEQ ID NO: 8411 - protein, 107 aa, Artificial Sequence; identical to SEQ ID NO: 8407
  Description of Artificial Sequence: Synthetic polypeptide

SEQ ID NO: 8412 - protein, 107 aa, Artificial Sequence; identical to SEQ ID NO: 8401
  Description of Artificial Sequence: Synthetic polypeptide

SEQ ID NO: 8413 - protein, 113 aa, Artificial Sequence
  Description of Artificial Sequence: Synthetic polypeptide
EIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKR

SEQ ID NO: 8414 - protein, 113 aa, Artificial Sequence
  Description of Artificial Sequence: Synthetic polypeptide
NIMLTQSPSSLAVSAGEKVTMSCKSSQSVFFSSSQKNYLAWYQQIPGQSPKLLIYWASTRESGVPDRFTGSGSGTDFTLTISSVQSEDLAIYYCHQYLSSRTFGGGTKLEIKR

SEQ ID NO: 8415 - protein, 107 aa, Artificial Sequence; identical to SEQ ID NO: 8399
  Description of Artificial Sequence: Synthetic polypeptide

SEQ ID NO: 8416 - protein, 107 aa, Artificial Sequence; identical to SEQ ID NO: 8400
  Description of Artificial Sequence: Synthetic polypeptide

SEQ ID NO: 8417 - protein, 107 aa, Artificial Sequence; identical to SEQ ID NO: 8401
  Description of Artificial Sequence: Synthetic polypeptide

SEQ ID NO: 8418 - protein, 107 aa, Artificial Sequence; identical to SEQ ID NO: 8402
  Description of Artificial Sequence: Synthetic polypeptide

SEQ ID NO: 8419 - protein, 107 aa, Artificial Sequence; identical to SEQ ID NO: 8403
  Description of Artificial Sequence: Synthetic polypeptide

SEQ ID NO: 8420 - protein, 107 aa, Artificial Sequence; identical to SEQ ID NO: 8404
  Description of Artificial Sequence: Synthetic polypeptide

SEQ ID NO: 8421 - protein, 107 aa, Artificial Sequence; identical to SEQ ID NO: 8405
  Description of Artificial Sequence: Synthetic polypeptide

SEQ ID NO: 8422 - protein, 107 aa, Artificial Sequence; identical to SEQ ID NO: 8406
  Description of Artificial Sequence: Synthetic polypeptide

SEQ ID NO: 8423 - protein, 107 aa, Artificial Sequence; identical to SEQ ID NO: 8407
  Description of Artificial Sequence: Synthetic polypeptide

SEQ ID NO: 8424 - protein, 107 aa, Artificial Sequence; identical to SEQ ID NO: 8407
  Description of Artificial Sequence: Synthetic polypeptide

SEQ ID NO: 8425 - protein, 107 aa, Artificial Sequence; identical to SEQ ID NO: 8407
  Description of Artificial Sequence: Synthetic polypeptide

SEQ ID NO: 8426 - protein, 107 aa, Artificial Sequence; identical to SEQ ID NO: 8407
  Description of Artificial Sequence: Synthetic polypeptide

SEQ ID NO: 8427 - protein, 107 aa, Artificial Sequence; identical to SEQ ID NO: 8407
  Description of Artificial Sequence: Synthetic polypeptide

SEQ ID NO: 8428 - protein, 107 aa, Artificial Sequence; identical to SEQ ID NO: 8401
  Description of Artificial Sequence: Synthetic polypeptide

SEQ ID NO: 8429 - protein, 95 aa, Artificial Sequence; identical to SEQ ID NO: 8374
  Description of Artificial Sequence: Synthetic polypeptide

SEQ ID NO: 8430 - protein, 94 aa, Artificial Sequence; identical to SEQ ID NO: 8373
  Description of Artificial Sequence: Synthetic polypeptide

SEQ ID NO: 8431 - protein, 108 aa, Artificial Sequence
  Description of Artificial Sequence: Synthetic polypeptide
DIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKR

SEQ ID NO: 8432 - protein, 107 aa, Artificial Sequence
  Description of Artificial Sequence: Synthetic polypeptide
DIVMTQSHKLLSTSVGDRVSITCKASQDVSTAVDWYQQKPGQSPKLLINWASTRHTGVPDRFTGSGSGTDYTLTISSMQAEDLALYYCRQHYSTPFTFGSGTKLEIK

SEQ ID NO: 8433 - protein, 108 aa, Artificial Sequence; identical to SEQ ID NO: 8431
  Description of Artificial Sequence: Synthetic polypeptide

SEQ ID NO: 8434 - protein, 108 aa, Artificial Sequence; identical to SEQ ID NO: 8431
  Description of Artificial Sequence: Synthetic polypeptide

SEQ ID NO: 8435 - protein, 115 aa, Artificial Sequence
  Description of Artificial Sequence: Synthetic polypeptide
QVQVKESGPGLVAPSQSLSITCTVSGFSLTTSGVSWVRQPPGKGLEWLGVIWGDGSTNYHSALKSRLSIKKDHSKSQVFLKLNSLQTDDTATYYCAKGGYSLAHWGQGTLVTVSA

SEQ ID NO: 8436 - protein, 110 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGDQ

SEQ ID NO: 8437 - protein, 108 aa, Artificial Sequence
  Description of Artificial Sequence: Synthetic polypeptide
DIQMTQSPSSLSASVGDRVTITCRTSENVYSYLAWYQQKPGKAPKLLVSFAKTLAEGVPSRFSGSGSGTDFTLTISSLQPEDFATYFCQHHSDNPWTFGQGTKVEIKR

SEQ ID NO: 8438 - protein, 108 aa, Artificial Sequence
  Description of Artificial Sequence: Synthetic polypeptide
DIVMTQSPSSLSASVGDRVTITCRVSENVYSYLAWYQQKPGKAPKLLISFAKTLAEGVPSRFSGSGSGTDFTLTISSLQPEDFATYFCQHHSDNPWTFGQGTKVEIKR

SEQ ID NO: 8439 - protein, 108 aa, Artificial Sequence
  Description of Artificial Sequence: Synthetic polypeptide
DIQMTQSPSSLSASVGDRVTITCRTSENVYSYLAWYQQKPGKAPKLLVSFAKTLAEGVPSRFSGSGSGTQFTLTISSLQPEDFATYFCQHHSDNPWTFGGGTELEIKR

SEQ ID NO: 8440 - protein, 108 aa, Artificial Sequence
  Description of Artificial Sequence: Synthetic polypeptide
DIVMTQSPATLSLSPGERATLSCRTSENVYSYLAWYQQKPGQAPRLLVSFAKTLAEGVPARFSGSGSGTDFTLTISSLEPEDFAVYFCQHHSDNPWTFGQGTKVEIKR

SEQ ID NO: 8441 - protein, 108 aa, Artificial Sequence
  Description of Artificial Sequence: Synthetic polypeptide
DIVMTQSPATLSLSPGERATLSCRVSENVYSYLAWYQQKPGQAPRLLISFAKTLAEGVPARFSGSGSGTDFTLTISSLEPEDFAVYFCQHHSDNPWTFGQGTKVEIKR

SEQ ID NO: 8442 - protein, 108 aa, Artificial Sequence
  Description of Artificial Sequence: Synthetic polypeptide
DIVMTQSPATLSLSPGERATLSCRTSENVYSYLAWYQQKPGQAPRLLVSFAKTLAEGVPARFSGSGSGTQFTLTISSLEPEDFAVYFCQHHSDNPWTFGGGTELEIKR

SEQ ID NO: 8443 - protein, 106 aa, Artificial Sequence; identical to SEQ ID NO: 3203
  Description of Artificial Sequence: Synthetic polypeptide

SEQ ID NO: 8444 - protein, 214 aa, Artificial Sequence; identical to SEQ ID NO: 7609
  Description of Artificial Sequence: Synthetic polypeptide

SEQ ID NO: 8445 - protein, 214 aa, Artificial Sequence; identical to SEQ ID NO: 7609
  Description of Artificial Sequence: Synthetic polypeptide

SEQ ID NO: 8446 - protein, 214 aa, Artificial Sequence; identical to SEQ ID NO: 7610
  Description of Artificial Sequence: Synthetic polypeptide

SEQ ID NO: 8447 - protein, 108 aa, Artificial Sequence; identical to SEQ ID NO: 8431
  Description of Artificial Sequence: Synthetic polypeptide

SEQ ID NO: 8448 - protein, 214 aa, Artificial Sequence; identical to SEQ ID NO: 7610
  Description of Artificial Sequence: Synthetic polypeptide

SEQ ID NO: 8449 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGQGTKVEIK

SEQ ID NO: 8450 - protein, 107 aa, Artificial Sequence [sequence omitted]

SEQ ID NO: 8451 - protein, 109 aa, Artificial Sequence
  Description of Artificial Sequence: Synthetic polypeptide
DIELTQPPSVSVAPGQTARISCSGDNLRHYYVYWYQQKPGQAPVLVIYGDSKRPSGIPERFSGSNSGNTATLTISGTQAEDEADYYCQTYTGGASLVFGGGTKLTVLGQ

SEQ ID NO: 8452 - protein, 107 aa, Artificial Sequence [sequence omitted]

SEQ ID NO: 8453 - protein, 107 aa, Artificial Sequence; identical to SEQ ID NO: 8449
  Description of Artificial Sequence: Synthetic polypeptide

SEQ ID NO: 8454 - protein, 107 aa, Artificial Sequence
  Description of Artificial Sequence: Synthetic polypeptide
EIVLTQSPATLSLSPGERATLSCRASQSVSSYLAWYQQKPGQAPGLLIYDASNRASGIPARFSGSGSGTDFTLTISSLEPEDFAVYYCQQRSNWPLTFGGGTKVEIK

SEQ ID NO: 8455 - protein, 112 aa, Artificial Sequence
  Description of Artificial Sequence: Synthetic polypeptide
NIVLTQSPASLAVSLGQRATISCRASESVEIYGNGFMNWFQQKPGQPPKLLIYRASNLESGIPARFSGSGSRTEFTLTIDPVEADDVATYYCQQINEDPFTFGSGTKLEIKR

SEQ ID NO: 8456 - protein, 112 aa, Artificial Sequence
  Description of Artificial Sequence: Synthetic polypeptide
DIVLTQSPASLAVSLGQRATISCRASESVAIYGNSFLKWFQQKPGQPPKLLIYRASNLESGIPARFSGSGSGTDFTLTINPVEADDVATYYCQQINEDPYTFGGGTKLEIKR

SEQ ID NO: 8457 - protein, 108 aa, Artificial Sequence
  Description of Artificial Sequence: Synthetic polypeptide
DIVMAQSHKFMSTSVGDRVSITCKASQDVSTVVAWYQQKPGQSPKRLIYSASYRYIGVPDRFTGSGSGTDFTFTISSVQAEDLAVYYCQQHYSPPYTFGGGTKLEIKR

SEQ ID NO: 8458 - protein, 108 aa, Artificial Sequence
  Description of Artificial Sequence: Synthetic polypeptide
DIVMTQSHKFLSTSVGDRVSITCKASQDVVTAVAWFQQKPGQSPKLLIYSASHRYTGVPDRFTGSGSGTDFTFTIISVQAEDLAVYYCQQHYTTPTTFGGGTKLDFRR

SEQ ID NO: 8459 - protein, 108 aa, Artificial Sequence
  Description of Artificial Sequence: Synthetic polypeptide
DTVMTQSHKFISTSVGDRVSITCKASQVVGSAVAWYQQKPGQSPKLLIYWASTRHTGVPDRFTGSGSGTDFTLTISNVQSEDLADYFCQQYNSYPYTFGGGTKLEIKR

SEQ ID NO: 8460 - protein, 108 aa, Artificial Sequence
  Description of Artificial Sequence: Synthetic polypeptide
DIVMTQSQKFMSTSVGDRVSVTCKASQNVGTNVAWYQHKPGQSPKIMIYSASSRYSGVPDRFTGSGSGTLFTLTINNVQSEDLAEYFCQQYNSYPLTFGSGTKLEIKR

SEQ ID NO: 8461 - protein, 108 aa, Artificial Sequence
  Description of Artificial Sequence: Synthetic polypeptide
DIVMTQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKR

SEQ ID NO: 8462 - protein, 108 aa, Artificial Sequence
  Description of Artificial Sequence: Synthetic polypeptide
DIVMAQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKR

SEQ ID NO: 8463 - protein, 108 aa, Artificial Sequence
  Description of Artificial Sequence: Synthetic polypeptide
DTVMTQSPSTISTSVGDRVSITCKASQVVGSAVAWYQQKPGQSPKLLIYWASTRHTGVPDRFTGSGSGTDFTLTISNVQSDDLADYFCQQYNSYPYTFGGGTKLEIKR

SEQ ID NO: 8464 - protein, 108 aa, Artificial Sequence
  Description of Artificial Sequence: Synthetic polypeptide
DTVMTQSPSSISTSIGDRVSITCKASQVVGSAVAWYQQKPGQSPKLLIYWASTRHTGVPARFTGSGSGTDFTLTISNVQSEDLADYFCQQYNSYPYTFGGGTKLEIKR

SEQ ID NO: 8465 - protein, 116 aa, Artificial Sequence
  Description of Artificial Sequence: Synthetic polypeptide
QAVLTQPASLSASPGESARLTCTLPSDINVRYYNIYWYQQKPGSPPRYLLYYYSDSHKGQGSGVPSRFSGSKDVSTNSGILLISGLQSEDEADYYCMTWSSNGSGVFGGGTQLTVL

SEQ ID NO: 8466 - protein, 108 aa, Artificial Sequence
  Description of Artificial Sequence: Synthetic polypeptide
AIQMTQSPSSLSASVGDRVTITCRASQSISSYLNWYQQKPGKAPKLLIYAASSLQSGVPSRFSGSGSGTDFTLTISSLQPEDFATYYCQQSYFTPLYTFGQGTKLEIK

SEQ ID NO: 8467 - protein, 116 aa, Artificial Sequence
  Description of Artificial Sequence: Synthetic polypeptide
QAVLTQPASLSASPGESARLTCTLPSDINVRYYNIYWYQQKPGSPPRYLLYYYSDSHKDQGSGVPSRFSGSKDTSANTGILLISGLQSEDEADYYCMIWASNGSGVLGGGTQLTVL

SEQ ID NO: 8468 - protein, 116 aa, Artificial Sequence
  Description of Artificial Sequence: Synthetic polypeptide
QAVLTQPASLSASPGESARLTCTLPSDINVRYHNIYWYQEKPGSPPRYLLYYYSDSSKGQGSGVPSRFSGSKDVSTNTGILVISGLQSEDEAEYYCMTWSSNGSGVFGGGTQLTVL

SEQ ID NO: 8469 - protein, 107 aa, Artificial Sequence
  Description of Artificial Sequence: Synthetic polypeptide
DIQMTQSPASLSASLGETVTIECRASEDIYSNLAWYQQKPGNSPQLLIYDANSLADGVPSRFSASGSGTQFSLKINSLRSEDVASYFCQQYNNYPYTFGAGTKLELK

SEQ ID NO: 8470 - protein, 112 aa, Artificial Sequence
  Description of Artificial Sequence: Synthetic polypeptide
DIVMTQGALPNPVPSGESASITCQSSESLLHSNGKTYLNWYLQRPGQSPQLLIYWMSTRAAGVSDRFSGSGSGTDFTLTISGVEAEDVGVYYCQQFLEYPPTFGSGTKLEIK

SEQ ID NO: 8471 - protein, 107 aa, Artificial Sequence
  Description of Artificial Sequence: Synthetic polypeptide
DIVMTQSPTSISISVGERVTMNCKASQNVDSDVDWYQQKTGQSPKLLIYKASNRYTGVPDRFTGSGSGTDFTFTISNMQAEDLAVYYCMQSNTHPRTFGGGTKLELK

SEQ ID NO: 8472 - protein, 107 aa, Artificial Sequence
  Description of Artificial Sequence: Synthetic polypeptide
EIVLTQSPATLSASPGERATLSCRASQSISSNLAWYQQKPGQAPRLLIQDSSTRATGIPARFSGSGSGTEFTLTISSLQSEDFAVYYCQQSDNWPLTFGGGTKVDIK

SEQ ID NO: 8473 - protein, 112 aa, Artificial Sequence
  Description of Artificial Sequence: Synthetic polypeptide
DVVMTQSPLSLPVTPGEPASISCRSSQSLLNSNGYNYLEWYVQKPGQSPQLLIFLGSNRASGVPDRFSGSGSGTDFTLKINRVEAEDVGVYYCMQALQSPLTFGGGTKVEIK

SEQ ID NO: 8474 - protein, 107 aa, Artificial Sequence [sequence omitted]

SEQ ID NO: 8475 - protein, 113 aa, Artificial Sequence
  Description of Artificial Sequence: Synthetic polypeptide
DVVVTQTPLSLPVSLGAQASISCRSSQSLVHSNGNTFLHWYLQKPGQSPKLLIYTVSNRFSGVPDRFSGSGSGTDFTLKISRVEAEDLGVYFCSQTTHVPWTFGGGTKLEIQR

SEQ ID NO: 8476 - protein, 113 aa, Artificial Sequence
  Description of Artificial Sequence: Synthetic polypeptide
DIQMTQSPSSLSASVGDRVTITCRSSQSLVHSNGNTFLHWYQQKPGKAPKLLIYTVSNRFSGVPSRFSGSGSGTDFTLTISSLQPEDFATYYCSQTTHVPWTFGQGTKVEIKR

SEQ ID NO: 8477 - protein, 113 aa, Artificial Sequence
  Description of Artificial Sequence: Synthetic polypeptide
DVQVTQSPSSLSASVGDRVTITCRSSQSLVHSNGNTFLHWYQQKPGKAPKLLIYTVSNRFSGVPSRFSGSGSGTDFTLTISSLQPEDFATYYCSQTTHVPWTFGQGTKVEIKR

SEQ ID NO: 8478 - protein, 113 aa, Artificial Sequence
  Description of Artificial Sequence: Synthetic polypeptide
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKR

SEQ ID NO: 8479 - protein, 108 aa, Artificial Sequence
  Description of Artificial Sequence: Synthetic polypeptide
DIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKR

SEQ ID NO: 8480 - protein, 112 aa, Artificial Sequence
  Description of Artificial Sequence: Synthetic polypeptide
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIR

SEQ ID NO: 8481 - protein, 108 aa, Artificial Sequence
  Description of Artificial Sequence: Synthetic polypeptide
DIQMTQSPSSLSASVGDRVTITCRASQNIGEDLEWYQQKPGNAPKLLIYSASHLQSGVPSRFSGSGSGTDFTLTISSLQPEDFATYYCQQYSSYPVTFGQGTKVEIKR

SEQ ID NO: 8482 - protein, 108 aa, Artificial Sequence
  Description of Artificial Sequence: Synthetic polypeptide
DIQMTQSPSSLSASVGDRVTITCRASQPIDEDLEWYQQKPGNAPKLLIYSASYLQSGVPSRFSGSGSGTDFTLTISRLQPEDFATYYCQQYHLLPATFGQGTKVEIKR

SEQ ID NO: 8483 - protein, 108 aa, Artificial Sequence
  Description of Artificial Sequence: Synthetic polypeptide
DIQMIQSPSSLSASVGDRVTITCRASQDINEDLEWYQQKPGKAPKLLIYNASMLQSGVPSRFSGSGSGTDFTLTISSLQPKDFATYYCQQYHTNPTTFGQGTKVEIKR

SEQ ID NO: 8484 - protein, 108 aa, Artificial Sequence
  Description of Artificial Sequence: Synthetic polypeptide
DIQMTQSPSSLSASVGDRVTITCRASQDIEADLEWYQQKPGKAPKLLIYHSSELQSGVPSRFSGSGSGTDFTLTISSLQPEDFATYYCQQYHMSPVTFGQGTKVEIKR

SEQ ID NO: 8485 - protein, 108 aa, Artificial Sequence
  Description of Artificial Sequence: Synthetic polypeptide
DIQMTQSPSSLSASVGDRVTITCRASQDIDSDLEWYQQKPGKAPMLLIYSSSDLQSGVPSRFSGSGSGTDFTLTISSLQPEDFATYYCQQYHSLPVTFGQGTKVEIKR

SEQ ID NO: 8486 - protein, 108 aa, Artificial Sequence
  Description of Artificial Sequence: Synthetic polypeptide
DIQMTQSPSSLSASVGDRVTITCRASQDISDDLEWYQQKPGKAPKLLIYNSSFLQSGVPSRFSGSGSGADFTLTISSLQPEDFATYYCQQYHSLPVTFGQGTKVEIKR

SEQ ID NO: 8487 - protein, 108 aa, Artificial Sequence
  Description of Artificial Sequence: Synthetic polypeptide
DIQMTQSPSSLSASVGDRVTITCRASQDIEGNLEWYQQKPGKAPKLLIYDSSQLQSGVPSRFSGSGSGTDFTLTISSLQPEDFATYYCQQYHHLPTTFGQGTKVEIKR

SEQ ID NO: 8488 - protein, 108 aa, Artificial Sequence
  Description of Artificial Sequence: Synthetic polypeptide
DIQMTQSPSSLSASVGDRVTITCRASQSIDTDLEWYQQKPGKAPKLLIYDGSWLQSGVPSRFSGSGSGTDFTLTISSLQPEDFATYYCQQYRWIPVTFGQGTKVEIKR

SEQ ID NO: 8489 - protein, 108 aa, Artificial Sequence
  Description of Artificial Sequence: Synthetic polypeptide
DIQMTQSPSSLSASVGDRVTITCRASQSISTDLEWYQQKLGKAPKLLIYDASLLQSGVPSRFSGSGSGTDFTLTISSLQPEDFATYYCQQYSSLPVTFGQGTKVEIKR

SEQ ID NO: 8490 - protein, 108 aa, Artificial Sequence
  Description of Artificial Sequence: Synthetic polypeptide
DIQMTQSPSSLSASVGDRVTITCRASQPITTSLEWYQQKPGKAPKLLIYDASMLQSGVPSRFSGSGSGTDFTLTISSLQPEDFATYYCQQYWVTPVTFGQGTKVEIKR

SEQ ID NO: 8491 - protein, 108 aa, Artificial Sequence
  Description of Artificial Sequence: Synthetic polypeptide
DIQMTQSPSSLSASVGDRVTITCRASQNIHTNLEWYQQKPGKAPKLLIYDGSMLQSGVPSRFSGSGSGTDFTLTISSLQPEDFATYYCQQYSANPVTFGQGTKVGIKR

SEQ ID NO: 8492 - protein, 108 aa, Artificial Sequence
  Description of Artificial Sequence: Synthetic polypeptide
DIQMTQSPSSLSASVGDRVTITCRASQWIHTDLEWYQQKPGKAPKLLIYDGSMLQSGVPSRFSGSGSGTDFTLTISSLQPEDFATYYCQQYSVSPVTFGQGTKVEIKR

SEQ ID NO: 8493 - protein, 108 aa, Artificial Sequence
  Description of Artificial Sequence: Synthetic polypeptide
DIQMTQSPSSLSASVGDRVTITCRASQSIDNNLEWYQQKPGEAPKLLIYDGSLLQSGVPSRFSGSGSGTDFTLTISSLQPEDFATYYCQQYHLHPVTFGQGTKVEIKR

SEQ ID NO: 8494 - protein, 108 aa, Artificial Sequence
  Description of Artificial Sequence: Synthetic polypeptide
DIQMTQSPSSLSASVGDRVTITCRASQDIDTNLEWYQQKPGEAPKLLIYDRSTLQSGVPSRFSGSGSGTDFTLTISSLQPEDFATYYCQQYDSYPVTFGQGTKVEIKR

SEQ ID NO: 8495 - protein, 108 aa, Artificial Sequence
  Description of Artificial Sequence: Synthetic polypeptide
DIQMTQSPSSLSASVGDRVTITCRASQSIESNLEWYQQKPGKAPKLLIYNASELQSGVPSRFSGSGSGTDFTLTISSLRPEDFATYYCQQYDQWPTTFGQGTKVEIKR

SEQ ID NO: 8496 - protein, 108 aa, Artificial Sequence
  Description of Artificial Sequence: Synthetic polypeptide
DIQMTQSPSSLSASVGDRVTITCRASQAIGNTLRWYQQKPGKAPKLLIYLSSRLQSGVPSRFSGSGSGTDFTLTISSLQPEDFATYYCQQLKKPPYTFGQGTKVEIKR

SEQ ID NO: 8497 - protein, 108 aa, Artificial Sequence
  Description of Artificial Sequence: Synthetic polypeptide
DIQMTQSPSSLSASVGDRVTITCRASQKIKNRLAWYQQKPGKAPKLLIYEVSHLQSGVPSRFSGSGSGTDFTLTIGSLQPEDFATYYCQQRRQSPYTFGQGTKVEIKR

SEQ ID NO: 8498 - protein, 108 aa, Artificial Sequence
  Description of Artificial Sequence: Synthetic polypeptide
DIQMTQSPSSLSASVGDRVTITCRASEDIGEELFWYQQKPGKAPKLLIYSASTLQSEVPSRFSGSGSGTDFTLTISSLQHEDFATYYCQQVYEWPYTFGQGTKVEIKR

SEQ ID NO: 8499 - protein, 108 aa, Artificial Sequence
  Description of Artificial Sequence: Synthetic polypeptide
DIQMTQSPSSLSASVGDRVTITCRASQPISGGLRWYQQKPGKAPKLLIYSTSMLQSGVPSRFSGSGSGTDFTLTISSLQPEDFATYYCQQLYSAPYTFGQGTKVEIKR

SEQ ID NO: 8500 - protein, 108 aa, Artificial Sequence
  Description of Artificial Sequence: Synthetic polypeptide
DIQMTQSPSSLSASVGDRVTITCRASQDIDQDLEWYQQKPGKAPKLLIYNVSLLQSGVPSRFSGSGSGTDFTLTISSLQPEDFATYYCQQYSMNPVTFGQGTKVEIKR

SEQ ID NO: 8501 - protein, 108 aa, Artificial Sequence
  Description of Artificial Sequence: Synthetic polypeptide
DIQMTQSPSSLSASVGDRVTITCRASQDIGNQLKWYQQKPGKAPKLLIYQASGLQSGVPSRFSGSGSGTDFTLTISSLQPEDFATYYCQQYDLRPQTFGQGTKVEIKR

SEQ ID NO: 8502 - protein, 108 aa, Artificial Sequence
  Description of Artificial Sequence: Synthetic polypeptide
DIQMTQSPSFLSASVGDRVTITCRASQKISTSLEWYQQKPGKAPRLLIYDSSWLQSGVPSRFSGSGSGTDFTLTISSLQPEDFATYYCQQYEYNPITFGQGTKVEIKR

SEQ ID NO: 8503 - protein, 108 aa, Artificial Sequence
  Description of Artificial Sequence: Synthetic polypeptide
DIQMTQSPSSLSASVGDRVTITCRASQTIGESLHWYQQKPGKAPRLLIYFASLLQSGVPSRFSGSGSGTDFTLTISSLQPEDFATYYCQQHHMLPSTFGQGTKVEIKR

SEQ ID NO: 8504 - protein, 108 aa, Artificial Sequence
  Description of Artificial Sequence: Synthetic polypeptide
DIQMTQSPSSLSASVGDRVTITCRASQFIGDSLSWYQQKPGKAPKLLIYFSSILQSGVPSRFSGSGSGTDFTLTISSLQPEDFATYYCQQYMDIPITFGQGTKVEIKR

SEQ ID NO: 8505 - protein, 108 aa, Artificial Sequence
  Description of Artificial Sequence: Synthetic polypeptide
DIQMTQSPSSLSASVGDRVTITCRASQDIDHNLEWYQQKPGKAPKLLIYDSSMLQSGVPSRFSGSGSGTDFTLTISSLQPEDFATYYCQQYHSIPVTFGQGTKVEIKR

SEQ ID NO: 8506 - protein, 108 aa, Artificial Sequence
  Description of Artificial Sequence: Synthetic polypeptide
DIQMTQSPSSLSASVGDRVTITCRASQQIETNLEWYQQKPGKAPKLLIYDGSWLQSGVPSRFSGSGSGTDFTLTISSLQPEDFATYYCQQYHSLPATFGQGTKVEIKR

SEQ ID NO: 8507 - protein, 108 aa, Artificial Sequence
  Description of Artificial Sequence: Synthetic polypeptide
DIQMTQSPSSLSASVGDRVTITCRASQDIGNNLEWYQQKPGKAPRLLIYHGSWLQSGVPSRFSGSGSGTDFTLTISSLQPEDFATYYCQQYDFNPTTFGQGTKVEIKR

SEQ ID NO: 8508 - protein, 108 aa, Artificial Sequence
  Description of Artificial Sequence: Synthetic polypeptide
DIQMTQSPSSLSASVGDCVTITCRASQNIDGLLWWYQQKPGKAPKLLIYAGSGLQSGVPSRFSGSGSGTDFTLTISSLQPEDFATYYCQQKAFEPFTFGQGTKVEIKR

SEQ ID NO: 8509 - protein, 108 aa, Artificial Sequence
  Description of Artificial Sequence: Synthetic polypeptide
DIQMTQTPSSLSASVGDRVTITCRASQSIGHDLEWYQQKPGKAPKLLIYNVSWLQSGVPSRFSGSGSGTDFTLTISSLQPEDFATYYCQQYSHNPPTFGQGTKVEIKR

SEQ ID NO: 8510 - protein, 108 aa, Artificial Sequence
  Description of Artificial Sequence: Synthetic polypeptide
DIQMTQSPSSLSASVGDRVTITCRASQHIENDLEWYQQKPGKAPKLLIYSASHLQSGVPSRFSGSGSGTDFTLTISSLQPEDFATYYCQQYHLQPTTFGPGTKVEIKR

SEQ ID NO: 8511 - protein, 108 aa, Artificial Sequence
  Description of Artificial Sequence: Synthetic polypeptide
DIQMTQSPSSLSASVGDRVTITCRASQVIEGSLNWYQQKPGKAPKLLIYHRSILQSGVPSRFSGRGSGTDFTLTISSLQPEDFATYYCQQTYQLPLTFGQGTKVEIKR

SEQ ID NO: 8512 - protein, 108 aa, Artificial Sequence
  Description of Artificial Sequence: Synthetic polypeptide
DIQMTQSPSSLSASVGDRVTITCRASRPINGKLFWYQQKPGKAPKLLIAFASALQSGVPSRFSGSGSGTDFTLTISSLQPEDFATYYCVQQAVYPITFGQGTKVEIKR

SEQ ID NO: 8513 - protein, 108 aa, Artificial Sequence
  Description of Artificial Sequence: Synthetic polypeptide
DIQMTQSPSSLSASVGDRVTITCRASQAIETNLEWYQQKPGKAPKLLIYDGSLLQSGVPSRFSGRGSGTDFTLTISSLQPEDFATYYCQQYHYQPATFGQGTKVEIKR

SEQ ID NO: 8514 - protein, 108 aa, Artificial Sequence
  Description of Artificial Sequence: Synthetic polypeptide
DIQMTQSPSSLSASVGDRVTITCRASQDIEHDLEWYQQKPGKAPKLLIYSASQLQSGVPSRFSGSGSGTDFTLTISSLQPEDFATYYCQQYQQQPTTFGQGTKVEIKR

SEQ ID NO: 8515 - protein, 108 aa, Artificial Sequence
  Description of Artificial Sequence: Synthetic polypeptide
DIQMTQSPSSLSASVGDRVTITCRASSQIEESLWWYQQKPGKAPKLLIADVSLLQSGVPSRFSGSGSGTDFTLTISSLQPEDFATYYCAQGVVEPRTFGQGTKVEIKR

SEQ ID NO: 8516 - protein, 108 aa, Artificial Sequence
  Description of Artificial Sequence: Synthetic polypeptide
DIQMTQSPSSLSASVGDRVTITCRASQYIGLDLEWYQQKPGKAPKLLIYAASWLQSGVPSRFSGSGSGTDFTLTISSLQPEDFATYYCQQYFRQPITFGQGTKVEIKR

SEQ ID NO: 8517 - protein, 108 aa, Artificial Sequence
  Description of Artificial Sequence: Synthetic polypeptide
DIQMTQSPSSLSASVGDRVTITCRASTPIGTMLDWYQQKPGKAPKLLIGHSSWLQSGVPSRFSGSGSGTDFTLTISSLQPEDFATYYCGQHVRPPATFGQGTKVEIKR

SEQ ID NO: 8518 - protein, 108 aa, Artificial Sequence
  Description of Artificial Sequence: Synthetic polypeptide
DIQLTQSPTSLSATVGDRVTITCRASTPIGTMLDWYQQKPGKAPKLLIGHSSWLQSGVPSRFSGSGSGTDFTLTISSLQPEDFATYYCGQHVRHPATFGQGTKVEIKR

SEQ ID NO: 8519 - protein, 108 aa, Artificial Sequence
  Description of Artificial Sequence: Synthetic polypeptide
DIQMTQSPSSLSASVGDRVTITCRASTPIGTMLDWYQQKPGKAPKLLIGHSSWLQSGVPSRFSGSGSGTDFTLTISSLQPEDFATYYCGQHVRPPATFGQGTKVGIKR

SEQ ID NO: 8520 - protein, 108 aa, Artificial Sequence
  Description of Artificial Sequence: Synthetic polypeptide
DIQMTQSPSSLSASVGDRVTITCRVSTPIGTMLDWYQQKPGKAPKLLIGHSSWLQSGVPPRFSGSGSGTDFTLTISSLQPEDFATYYCGQHVRPPATFGQGTKVEIKR

SEQ ID NO: 8521 - protein, 108 aa, Artificial Sequence
  Description of Artificial Sequence: Synthetic polypeptide
DIQMTQSPSSLSASVGDRVTITCRASTPIGTMLDWYQQKPGKAPKLLIGHSSWLQSGVPSRFSGCGSGTDFTLTISSLQPEDFATYYCGQHVRPPATFGQGTKVEIKR

SEQ ID NO: 8522 - protein, 108 aa, Artificial Sequence
  Description of Artificial Sequence: Synthetic polypeptide
DIQMTQSPSSLSASVGDRVTITCRASTPIGTMIDWYQQKPGKAPKLLIGHSSWLQSGVPSRFSGSGSGTDFTLTISSLQPEDFATYYCGQHVRPPATFGKGTKVEIKR

SEQ ID NO: 8523 - protein, 108 aa, Artificial Sequence
  Description of Artificial Sequence: Synthetic polypeptide
DIQMTQSPSSLSASVGDRVTITCRASQYIDTNLEWYQQKPGKAPRLLIYDGSQLQSGVPSRFSGSGSGTDFTLIISSLQPEDFATYYCQQYQVVPVTFGQGTKVEIKR

SEQ ID NO: 8524 - protein, 108 aa, Artificial Sequence
  Description of Artificial Sequence: Synthetic polypeptide
DIQMTQSPSSLSASVGDRVTITCRASQSISSYLNWYQQKPGKAPRLLIVDSSGLQSGVPSRFSGSGSGTDFTLTISSLQPEDFATYYCGQDRWSPATFGQGTKVEIKR

SEQ ID NO: 8525 - protein, 108 aa, Artificial Sequence
  Description of Artificial Sequence: Synthetic polypeptide
DIQMTQSPSSLSASVGDRVTITCRASSRIQHMLSWYQQKPGKAPKLLIGGHSGLQSGVPSRFSGSGSGTDFTLTISSLQPEDFATYYCAQSCAWPLTFGQGTKVEIKR

SEQ ID NO: 8526 - protein, 108 aa, Artificial Sequence
  Description of Artificial Sequence: Synthetic polypeptide
DIQMTQSPSSLSASVGDRVTITCRASRGIDGDLWWYQQKPGKAPKLLIADSSLLQSGVPSRFSGSGSGTDFTLTISSLQPEDFATYYCGQGAVRPMTFGQGTKVEIKR

SEQ ID NO: 8527 - protein, 108 aa, Artificial Sequence
  Description of Artificial Sequence: Synthetic polypeptide
DIQMTQSPSSLSASVGDRVTITCRASRGIDTDLWWYQQKPGKAPKLLIADSSLLQSGVPSRFSGSGSGTDFTLTISSLQPEDFATYYCGQGAVRPMTFGQGTKVEIKR

SEQ ID NO: 8528 - protein, 108 aa, Artificial Sequence
  Description of Artificial Sequence: Synthetic polypeptide
DIQMTQSPSSLSASVGDRVTITCRASYTIPVALDWYQQKPGKAPKLLIADASLLQSGVPSRFSGSGSGTDFTLTISSLQPEDFATYYCAQGWPGPQTFGQGTKVEIKR

SEQ ID NO: 8529 - protein, 108 aa, Artificial Sequence
  Description of Artificial Sequence: Synthetic polypeptide
DIQMTQSPSSLSASVGDRVTITCRASQSIATDLEWYQQKPGKAPKLLIYDTSMLQSGVPSRFSGSGSGTDFTLTISSLQPEDFATYYCQQYSYNPSTFGQGTKVEIKR

SEQ ID NO: 8530 - protein, 108 aa, Artificial Sequence
  Description of Artificial Sequence: Synthetic polypeptide
DIQMTQSPSSLSASVGDRVTITCRASVPITEGLSWYQQKPGKAPKLLIQANSWLQSGVPSRFSGSGSGTDFTLTISSLQPEDFATYYCGQWEHVPATFGQGTKVEIKR

SEQ ID NO: 8531 - protein, 108 aa, Artificial Sequence
  Description of Artificial Sequence: Synthetic polypeptide
DIQMTQSPSSLSASVGDRVTITCRASSMILYGLDWYQQKPGKAPKLLIGGTSALQSGVPSRFSGSGSGTDFTLTISSLQPEDFATYYCGQWETVPATFGQGTKVEIKR

SEQ ID NO: 8532 - protein, 108 aa, Artificial Sequence
  Description of Artificial Sequence: Synthetic polypeptide
DIQMTQSPSSLSASVGDRVTITCRASQPINGLLIWYQQKPGKAPKLLIYAMSSLQSGVPSRFSGSGSGTDFTLTISSLQPEDFATYYCQQLARIPFTFGQGTKVGIKR

SEQ ID NO: 8533 - protein, 108 aa, Artificial Sequence
  Description of Artificial Sequence: Synthetic polypeptide
DIQMTQSPSSLSASVGDRVTITCRASQLIRTYLAWYQQKPGKAPKLLIYQSSQLQSGVPSRFSGSGSGTDFTLTISSLQPEDFATYYCQQYNSYPDTFGQGTKVEIKR

SEQ ID NO: 8534 - protein, 108 aa, Artificial Sequence
  Description of Artificial Sequence: Synthetic polypeptide
DIQMTQSPSSLSASVGDRVTITCRASQWIGDSLSWYQQKPGKAPKLLIYFGSYLQSGVPSRFSGSGSGTDFTLTISSLQPEDFATYYCQQYLHTPSTFGQGTKVEIKR

SEQ ID NO: 8535 - protein, 108 aa, Artificial Sequence
  Description of Artificial Sequence: Synthetic polypeptide
DIQMTQSPSSLSASVGDRVTITCRASQDIEADLEWYQQKPGKAPKLLIYHSSELQSGVPSRFSGSGSGTDFTLTISSLQPEDFATYYCQQYGFNPPTFGQGTKVEIKR

SEQ ID NO: 8536 - protein, 108 aa, Artificial Sequence
  Description of Artificial Sequence: Synthetic polypeptide
DIQMTQSPSSLSASVGDRVTITCRASSPIEYGLDWYQQKPGKAPKLLIGGGSALQSGVPSRFSGSGSGTDFTLTISSLQPEDFATYYCGQWEVQPATFGQGTKVEIKR

SEQ ID NO: 8537 - protein, 108 aa, Artificial Sequence
  Description of Artificial Sequence: Synthetic polypeptide
DIQMTQSPSSLSASVGDRVTITCRASQRIDTDLEWYQQKPGKAPKLLIYDSSQLQSGVPSRFSGSGSGTDFTLTISSLQPEDFATYYCQQYHSAPATFGQGTKVEIKR

SEQ ID NO: 8538 - protein, 108 aa, Artificial Sequence
  Description of Artificial Sequence: Synthetic polypeptide
DIQMTQSPSSLSASVGDRVTITCRASGWIGMSLEWHQQKPGKAPKLLIRGASSLQSGVPSRFSGSGSGTDFTLTISSLQPEDFATYYCSQSRWPPVTFGQGTKVEIKR

SEQ ID NO: 8539 - protein, 108 aa, Artificial Sequence
  Description of Artificial Sequence: Synthetic polypeptide
DIQMTQSPSSLSASVGDRVTITCRASRNISNALSWYQQKPGKAPKLLILGASWLQSGVPSRFSGSGSGTDFTLTISSLQPEDFATYYCTQVWDRPFTFGQGTKVEIKR

SEQ ID NO: 8540 - protein, 108 aa, Artificial Sequence
  Description of Artificial Sequence: Synthetic polypeptide
DIQMTQSPSSLSASVGDRVTITCRASQDIMSALSWYQQKPGKAPKLLIYSTSILQSGVPSRFSGSGSGTDFTLTISSLQPEDFATYYCQQVYLLPVTFGQGTKVEIKR

SEQ ID NO: 8541 - protein, 108 aa, Artificial Sequence
  Description of Artificial Sequence: Synthetic polypeptide
DIQMTQSPSSLSASVGDRVTITCRASQEIGIDLEWYQQKPGKAPKLLIYAASYLQSGVPSRFSSSGSGTDFTLTISSLQPEDFATYYCQQYASNPPTFGRGTKVEIKR

SEQ ID NO: 8542 - protein, 108 aa, Artificial Sequence
  Description of Artificial Sequence: Synthetic polypeptide
DIQMTQSPSSLSASVGDRVTITCRASQMIGDWLNWYQQKPGKAPKLLIYRSSELQSGVPSRFSGSGSGTDFTLTISSLQPEDFATYYCQQLYFWPRTFGQGTKVEIKR

SEQ ID NO: 8543 - protein, 108 aa, Artificial Sequence
  Description of Artificial Sequence: Synthetic polypeptide
DIQMTQSPSSLSASVGDRVTITCRASQAIELNLEWYQQKPGKAPKLLIYDASMLQSGVPSRFSGSGSGTDFTLTISSLQPEDFATYYCQQYDVYPPTFGQGTKVEIKR

SEQ ID NO: 8544 - protein, 108 aa, Artificial Sequence
  Description of Artificial Sequence: Synthetic polypeptide
DIQMTQSPSSLSASVGDRVTITCRASQAIEHNLEWYQQKPGKAPKLLIYDASMLQSGVPSRFSGSGSGTDFTLTISSLQPEDLATYYCQQYDAYPPTYGQGTKVEIKR

SEQ ID NO: 8545 - protein, 108 aa, Artificial Sequence
  Description of Artificial Sequence: Synthetic polypeptide
DIQMTQSPSSLSASVGDRVTITCRASRAIETNLEWYQQKPGKAPKLLFYDASMLQSGVPSRFGGSGSGTDFTLTISSLQPEDFATYYCLQYDVYPPTFGQGTKVEIKR

SEQ ID NO: 8546 - protein, 108 aa, Artificial Sequence
  Description of Artificial Sequence: Synthetic polypeptide
DIQMTQSPSSLSATVGDRVTITCRASQAIETNLEWYQQKPGKAPKLLIYDASMLQSGVPSRFSGSGSGTDFTLTISSLQPEDFATYYCQQYDAYPPTFGQGTKVEIKR

SEQ ID NO: 8547 - protein, 108 aa, Artificial Sequence
  Description of Artificial Sequence: Synthetic polypeptide
DIQMTQSPSSLSASVGDRVTITCRASQAIEHNLEWYQQKPGKAPKLLIYDASMLQSGVPSRFSGRGSGTDFTLTISSLQPEDFATYYCQQYDAYPPTFGQGTKVEIKR

SEQ ID NO: 8548 - protein, 108 aa, Artificial Sequence
  Description of Artificial Sequence: Synthetic polypeptide
DIQMNQSPSSLSASVGDRVSITCRASQAIEHNLEWYQQKPGKAPKLLIYDASMLQSGVPSRFSGSGSGTDFTLTISSLQPEDFATYYCQQYDAYPPTFGQGTKVEIKR

SEQ ID NO: 8549 - protein, 108 aa, Artificial Sequence
  Description of Artificial Sequence: Synthetic polypeptide
DIQMTQSPSSLSASVGDRVTITCRASQAIESNLEWYQQKPGKAPKLLIYDASMLQSGVPSRFSGSGSGTDFTLTISSLQPEDFATYYCQQYDVYPPTFGQGTKVEIKR

SEQ ID NO: 8550 - protein, 108 aa, Artificial Sequence
  Description of Artificial Sequence: Synthetic polypeptide
DIQMTQSPSSLSASVGDRVTITCRASQAIEHNLEWYQQKPGKAPKLLIYDASMLQSGVPSRFSGSGSGTDFTLTISSLQPEDFATYYCQQYDAYPPTFGQGTKVEIKR

SEQ ID NO: 8551 - protein, 108 aa, Artificial Sequence
  Description of Artificial Sequence: Synthetic polypeptide
DIQMTQSPSSLSASVGDRVTITCRASQGIDEDLEWYQQKPGKAPRLLIYSSSWLQSGVPSRFSGSGSGTDFTLTISSLQPEDFATYYCQQYFQYPPTFGQGTKVEIKR

SEQ ID NO: 8552 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISSLQPEDFATYYCQQYFQYPPTFGQGTKVEIKR

SEQ ID NO: 8553 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISSLQPEDFATYYCQQYSQYPPTFGQGTKVEIKR

SEQ ID NO: 8554 - protein, 108 aa, Artificial Sequence
  Description of Artificial Sequence: Synthetic polypeptide
DIQMTQSPSSLSASVGDRVTITCRASQSIEEDLEWYQQKPGKAPRLLIYSSSWLQSGVPSRFSGSGSGTDFTLTISSLQPEDFATYYCQQYFQYPPTFGHGTKVEIKR

SEQ ID NO: 8555 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISSLQPEDFATYFCQQYFQYPPTFGQGTKVEIKR

SEQ ID NO: 8556 - protein, 108 aa, Artificial Sequence
  Description of Artificial Sequence: Synthetic polypeptide
EIQMTQSPSSLSASVGDRVTMTCRASQSIDKDLEWYQQKPGKAPRLLIYSSSWLQRGVPSRFSGSGSGTDFTLTISSLRPEDFATYYCQQYFQYPPTLGQGTKVEIKR

SEQ ID NO: 8557 - protein, 108 aa, Artificial Sequence
  Description of Artificial Sequence: Synthetic polypeptide
DIQMTQSPSSLSASVGDRVTITCRASQSIDEDLEWYQQKPGKAPRLLIYSSSWLQSGVPSRFSGSGSGTDFTLTISGLQPEDIATYYCKQYSQYPPTFGQGTKVEIKR

SEQ ID NO: 8558 - protein, 108 aa, Artificial Sequence
  Description of Artificial Sequence: Synthetic polypeptide
DIQMTQSPPSLSASVGDRVTITCRASQSIDKDLEWYQQKPGKAPRLLIYSSSWLQRGVPSRFSGSGSGTDFTLTISSLQPEDFATYHCQQYFQYPPTFGQGTKVEIKR

SEQ ID NO: 8559 - protein, 108 aa, Artificial Sequence
  Description of Artificial Sequence: Synthetic polypeptide
DIQMTQSPSSLSASVGDRVTITCRASEYINAELAWYQQKPGKAPKLLIYGSSGLQSGVPSRFSGSGSGTDFTLTISSLQPEDFATYYCLQNAMWPITFGQGTKVEIKR

SEQ ID NO: 8560 - protein, 108 aa, Artificial Sequence
  Description of Artificial Sequence: Synthetic polypeptide
DIQMTQSPSSLSASVGDRVTITCRASLDINNGLIWYQQKPGKAPRLLILGASGLQSGVPSRFSGSGSGTDFTLTISSLQPEDFATYYCSQVRSRPFTFGQGTKVEIKR

SEQ ID NO: 8561 - protein, 108 aa, Artificial Sequence
  Description of Artificial Sequence: Synthetic polypeptide
DIQMTQSPSSLSASVGDRVTITCRASQDILSALAWYQQKPGKAPKLLIYGSSVLQSGVPSRFSGSGSGTDFTLTISSLQPEDFATYYCQQNYSLPITFGQGTKVEIKR

SEQ ID NO: 8562 - protein, 108 aa, Artificial Sequence
  Description of Artificial Sequence: Synthetic polypeptide
DIQMTQSPSSLSASVGDRVTITCRASSPIESYLRWYQQKPGKAPKLLIRYVSVLQSGVPSRFSGSGSGTDFTLTISSLQPEDFATYYCGQWFRAPVTFGQGTKVEIKR

SEQ ID NO: 8563 - protein, 108 aa, Artificial Sequence
  Description of Artificial Sequence: Synthetic polypeptide
DIQMTQSPSSLSASVGDRVTITCRVSESINAELHWYQQKPGKAPKLLISGFSGLQSGVPSRFSGSGSGTDFTLTISSLQPEDFATYYCVQFAMWPFTFGQGTKVEIKR

SEQ ID NO: 8564 - protein, 108 aa, Artificial Sequence
  Description of Artificial Sequence: Synthetic polypeptide
DIQMTQSPSSLSASVGDRVTITCRASMMIRFGLDWYQQKPGKAPKLLIGGGSSLQSGVPSRFSGSGSGTDFTLTISSLQPEDFATYYCGQHERWPATFGQGTKVEIKR

SEQ ID NO: 8565 - protein, 108 aa, Artificial Sequence
  Description of Artificial Sequence: Synthetic polypeptide
DIQMTQSPSSLSASVGDRVTITCRASQSIGTLLRWYQQKPGKAPKLLIYLTSVLQSGVPSRFSGSGSGTDFTLTISSLQPEDFATYYCQQMVYRPYTFGQGTKVEIKR

SEQ ID NO: 8566 - protein, 108 aa, Artificial Sequence
  Description of Artificial Sequence: Synthetic polypeptide
DIQMTQSPSSLSASVGDRVTITCRASQTIETNLEWYQQKPGKAPKLLIYDSSQLQSGVPSRFSGSGSGTDFTLTISSLQPEDFATYYCQQYDKVPATFGQGTKVEIKR

SEQ ID NO: 8567 - protein, 108 aa, Artificial Sequence
  Description of Artificial Sequence: Synthetic polypeptide
DIQMTQSPSSLSASVGDRVTITCRASHHIQRYLSWYQQKPGKAPKLLILWGSQLQSGVPSRFSGSGSGTDFTLTISSLQPEDFATYYCGQWWAPPPTFGQGTKVEIKR

SEQ ID NO: 8568 - protein, 108 aa, Artificial Sequence
  Description of Artificial Sequence: Synthetic polypeptide
DIQMTQSPSSLSASVGDRVTITCRASHHIQRYLSWYQQKPGKAPKLLILWGSQLQSGVPSRFSGSGSGTDFTLTISSLQPEDFATYYCGQWWAPPQTFGQGTKVEIKR

SEQ ID NO: 8569 - protein, 108 aa, Artificial Sequence
  Description of Artificial Sequence: Synthetic polypeptide
DIQMTQSPSSLSASVGDRVTITCRASHDIQRYLSWYQQKPGKAPKLLILWGSQLQSGVPSRFSGSGSGTDFTLTISSLQPEDFATYYCGQWWAPPQTFGQGTKVEIKR

SEQ ID NO: 8570 - protein, 108 aa, Artificial Sequence
  Description of Artificial Sequence: Synthetic polypeptide
DIQMTQSPSSLSASVGDRVTITCRASQYIDTNLEWYQQKPGKAPKLLIYDGSLLQSGVPSRFSGSGSGTDFTLTISSLQPEDFATYYCGQGAVVPVTFGQGTKVEIKR

SEQ ID NO: 8571 - protein, 108 aa, Artificial Sequence
  Description of Artificial Sequence: Synthetic polypeptide
DIQMTQSPSSLSASVGDRVTITCRASQDIAFDLEWYQQKPGKAPKLLIYSASMLQSGVPSRFSGSGSGSDFTLTISSLQPEDFATYYCQQYNLQPPTFGQGTKVEIKR

SEQ ID NO: 8572 - protein, 108 aa, Artificial Sequence
  Description of Artificial Sequence: Synthetic polypeptide
DIQMTQSPSSLSASVGDRVTITCRASQNIATLLRWYQQKPGKAPKLLIYAGSMLQSGVPSRFSGSGSGTDFTLTISSLQPEDFATYYCQQMWQRPYTFGQGTKVEIKR

SEQ ID NO: 8573 - protein, 108 aa, Artificial Sequence
  Description of Artificial Sequence: Synthetic polypeptide
DIQMTQSPSSLSASVGDRVTITCRASQPIVDELDWYQQKPGKAPKLLIYAASILQSGVPSRFSGSGSGTDFTLTISSLQPEDFATYYCHQWSTYPTTFGQGTKVEIKR

SEQ ID NO: 8574 - protein, 108 aa, Artificial Sequence
  Description of Artificial Sequence: Synthetic polypeptide
DIQMTQSPSSLSASVGDRVTITCRASQSISSYLNWYQQKPGKAPKLLIDGVSGLQSGVPSRFSGSGSGTDFTLTISSLQPEDFATYYCGQDWDWPRTFGQGTKVEIKR

SEQ ID NO: 8575 - protein, 108 aa, Artificial Sequence
  Description of Artificial Sequence: Synthetic polypeptide
DIQMTQSPSSLSASVGDRVTITCRASRNIRDWLRWYQQKPGKAPKLLIDWGSVLQSGVPSRFSGSGSGTDFTLTISSLQPEDFATYYCAQTWDDPLTFGQGTKVEIKR

SEQ ID NO: 8576 - protein, 108 aa, Artificial Sequence
  Description of Artificial Sequence: Synthetic polypeptide
DIQMTQSPSSLSAFVGDRVTITCRASRNIRDWLRWYQQKPGKAPKLLIDWGSELQSGVPSRFSGSGSGTDFTLTISSLQPEDFATYYCAQTWYDPLTFGHGTKVEIKR

SEQ ID NO: 8577 - protein, 108 aa, Artificial Sequence
  Description of Artificial Sequence: Synthetic polypeptide
DIQMTQSPSSLSASVGDRVTITCRASIDIHGGLTWYQQKPGKAPKLLIVGVSGLQSGVPSRFSGSGSGTDFTLTISNLQPEDFATYYCAQVWRRPFTFGQGTKVEIKR

SEQ ID NO: 8578 - protein, 108 aa, Artificial Sequence
  Description of Artificial Sequence: Synthetic polypeptide
DIQMTQSPSSLSASVGDRVTITCRASQDIGSSLSWYQQKPGKAPKLLIYASSLLQSGVPSRFSGSGSGTDFTLTISSLQPEDFATYYCQQTYALPVTFGQGTKVEIKR

SEQ ID NO: 8579 - protein, 108 aa, Artificial Sequence
  Description of Artificial Sequence: Synthetic polypeptide
DIQMTQSPSSLSASVGDRVTITCRASQQIETNLEWYQQKPGKAPKLLIYDGSWLQSGVPSRFSGSGSGTDFTLTISSLQPEDFATYYCQQYKYLPVTFGQGTKVEIKR

SEQ ID NO: 8580 - protein, 108 aa, Artificial Sequence
  Description of Artificial Sequence: Synthetic polypeptide
DIQMTQSPSSLSASVGDRVTITCRASQDIGSALRWYQQKPGKAPKLLIYLGSDLQSGVPSRFSGSGSGTDFTLTISSLQPEDFATYYCQQTQYFPTTFGQGTKVEIKR

SEQ ID NO: 8581 - protein, 108 aa, Artificial Sequence
  Description of Artificial Sequence: Synthetic polypeptide
DIQMTQSPSSLSASVGDRVTITCRASQAIYGGLRWYQQKPGKAPKLLIYGESMLQSGVPSRFSGSGSGTDFTLTISSLHPEDFATYYCQQVYHKPFTFGQGTKVEIKR

SEQ ID NO: 8582 - protein, 108 aa, Artificial Sequence
  Description of Artificial Sequence: Synthetic polypeptide
DIQMTQSPSSLSASVGDRVTITCRASQRIGVWLDWYQQKPGKAPKLLIYDGSFLQSGVPSRFSGSGSGTDFTLTISSLQPEDFATYYCQQTFSSPSTFGQGTKVEIKR

SEQ ID NO: 8583 - protein, 108 aa, Artificial Sequence
  Description of Artificial Sequence: Synthetic polypeptide
DIQMTQSPSSLSASVGDRVPITCRASQWIGDELYWYQQKPGKAPKLLIYSSSTLQSGVPSRFSGSGSGTDFTLTISSLQPEDFATYYCQQSFQFPYTFGQGTKVEIKR

SEQ ID NO: 8584 - protein, 108 aa, Artificial Sequence
  Description of Artificial Sequence: Synthetic polypeptide
DIQMTQSPSSLSASVGDRVTITCRASSNITGPLEWYQQKPGKAPKLLIPGWSTLQSGVPSRFSGSGSGTDFTLTISSLQPEDFATYYCGQVWGEPVTFGQGTKVEIKR

SEQ ID NO: 8585 - protein, 108 aa, Artificial Sequence
  Description of Artificial Sequence: Synthetic polypeptide
DIQMTQSPSSLSASIGDRVTITCRASQRIAYGLHWYQQKPGKAPRLLIGGRSGLQSGVPSRFSGSGSGTDFTLTISSLQPEDFATYYCVQPGMPPDTFGQGTKVEIKR

SEQ ID NO: 8586 - protein, 108 aa, Artificial Sequence
  Description of Artificial Sequence: Synthetic polypeptide
DIQMTQSPSSLSASVGDRVTITCRASKQIVGGLSWYQQKPGKAPKLLIGRHSGLQSGVPSRFSGSGSGTDFTLTISSLQPEDFATYYCVQGVWAPGTFGQGTKVEIKR

SEQ ID NO: 8587 - protein, 108 aa, Artificial Sequence
  Description of Artificial Sequence: Synthetic polypeptide
DIQMTQSPSSLSASVGDRVTITCRASPAIAAKLDWYQQKPGKAPKLLIGADSGLQSGVPSRFSGSGSGTDFTLTISSLQPEDFATYYCGQLWAGPPTFGQGTKVEIKR

SEQ ID NO: 8588 - protein, 108 aa, Artificial Sequence
  Description of Artificial Sequence: Synthetic polypeptide
DIQMTQSPSSLSASVGDRVTITCRASRTIADGLDWYQQKPGKAPKLLIGAYSGLQSGVPSRFSGSGSGTDFTLTISSLQPEDFATYYCGQLWEGPPTFGQGTKVEIKR

SEQ ID NO: 8589 - protein, 108 aa, Artificial Sequence
  Description of Artificial Sequence: Synthetic polypeptide
DIQMTQSPSSLSASVGDRVTITCRASQRIYGFLDWYQQKPGKAPKLLIYGVSSLQSGVPSRFSGSGSGTDFTLTISSLQPEDFATYYCQQTLAWPFTFGQGTKVEIKR

SEQ ID NO: 8590 - protein, 108 aa, Artificial Sequence
  Description of Artificial Sequence: Synthetic polypeptide
DIQMTQSPSSLSASVGDRVTITCRASQDIRDWLMWYQQKPGKAPKLLIYWGSFLQSGVPSRFSGSGSGTDFTLTISSLQPEDFATYYCQQLYDTPYTFGQGTKVEIKR

SEQ ID NO: 8591 - protein, 108 aa, Artificial Sequence
  Description of Artificial Sequence: Synthetic polypeptide
DIQMTQSPSSLSASVGDRVTITCRASQNINTGLDWYQQKPGKAPKLLIYDSSALQSGVPSRFSGSGSGTDFTLTISSLQPEDFATYYCQQTSYYPYTFGQGTKVEIKR

SEQ ID NO: 8592 - protein, 108 aa, Artificial Sequence
  Description of Artificial Sequence: Synthetic polypeptide
DIQMTQSPSSLSASVGDRVTITCRASQKIFGWLDWYQQKPGKAPKLLIYGTSKLQSGVPSRFSGSGSGTDFTLTISSLQPEDFATYYCQQVYSLPYTFGQGTKVEIKR

SEQ ID NO: 8593 - protein, 108 aa, Artificial Sequence
  Description of Artificial Sequence: Synthetic polypeptide
DIQMTQSPSSLSASVGDRVTITCRASSNIGADLDWYQQKPGKAPKLLIGGASGLQSGVPSRFSGSGSGTDFTLTISSLQPEDFATYYCGQLWNGPPTFGQGTKVEIKR

SEQ ID NO: 8594 - protein, 108 aa, Artificial Sequence
  Description of Artificial Sequence: Synthetic polypeptide
DIQMTQSPSSLSASVGDRVTITCRASSPIYDGLDWYQQKPGKAPKLLISGASWLQSGVPSRFSGSGSGTDFTLTISSLQPEDFATYYCGQLWLGPPTFGQGTKVEIKQ

SEQ ID NO: 8595 - protein, 108 aa, Artificial Sequence
  Description of Artificial Sequence: Synthetic polypeptide
DIQMTQSPSSLSASVGDRVTITCRASSRIYNGLHWYQQKPGKAPKLLIGGRSGLQSGVPSRFSGSGSGTDFTLTISSLQPEDFATYYCAQVGEAPSTFGQGTKVEIKR

SEQ ID NO: 8596 - protein, 108 aa, Artificial Sequence
  Description of Artificial Sequence: Synthetic polypeptide
DIQMTQSPSSLSASVGDRVTITCRASRFINEELDWYQQKPGKAPKLLISWSSWLQSGVPSRFSGSGSGTDFTLTISSLQPEDFATYYCVQPGGGPGTFGQGTKVEIKR

SEQ ID NO: 8597 - protein, 108 aa, Artificial Sequence
  Description of Artificial Sequence: Synthetic polypeptide
DIQMTQSPSSLSASVGDRVTITCRASRDILDELDWYQQKPGKAPRLLIGGGSGLQSGVPSRFSGSGSGTDFTLTISSLQPEDFATYYCGQLWHGPPTFGQGTKVEIKR

SEQ ID NO: 8598 - protein, 108 aa, Artificial Sequence
  Description of Artificial Sequence: Synthetic polypeptide
DIQMTQSPSSLSASVGDRVTITCRASSPIYTGLHWYQQKPGKAPKLLIGGRSGLQSGVPSRFSGSGSGTDFTLTISSLQPEDFATYYCMQVGTAPATFGQGTKVEIKR

SEQ ID NO: 8599 - protein, 108 aa, Artificial Sequence
  Description of Artificial Sequence: Synthetic polypeptide
DIRMTQSPSSLSASVGDRVTITCRASQNISRRLLWYQQKPGKAPKLLIYSSSRLQSGVPSRFGGSGSGTDFTLTISSLQPEDFATYYCQQTYSYPHTFGQGTKVEIKR

SEQ ID NO: 8600 - protein, 108 aa, Artificial Sequence
  Description of Artificial Sequence: Synthetic polypeptide
DIQMTQSPSSLSASVGDRVTITCRASSPIPQDLYWYQQKPGKAPKLLIVGISQLQSGVPSRFSGSGSGTDFTLTISSLQPEDFATYYCGQLWSAPATFGQGTKVEIKR

SEQ ID NO: 8601 - protein, 108 aa, Artificial Sequence
  Description of Artificial Sequence: Synthetic polypeptide
DIQMTQSPSSLSASVGDRVTITCRASKSIDGMLDWYQQKPGKAPKLLIPGFSGLQSGVPSRFSGSGSGTDFTLTISSLQPEDFATYYCGQSVEAPWTFGQGTKVEIKR

SEQ ID NO: 8602 - protein, 108 aa, Artificial Sequence
  Description of Artificial Sequence: Synthetic polypeptide
DIQMTQSPSSLSASVGDRVTITCRASRYIAHPLDWYQQKPGKAPKLLIPGSSVLQSGVPSRFSGSGSGTDFTLTISSLQPEDFATYYCGQSVVVPWTFGQGTKVEIKR

SEQ ID NO: 8603 - protein, 108 aa, Artificial Sequence
  Description of Artificial Sequence: Synthetic polypeptide
DIQMTQSPSSLSASVGDRVTITCRASRTIEGGLDWYQQKPGKAPKLLIMGGSGLQSGVPSRFSGSGSGTDFTLTISSLQPEDFATYYCGQLWVGPPTFGQGTKVEIKR

SEQ ID NO: 8604 - protein, 108 aa, Artificial Sequence
  Description of Artificial Sequence: Synthetic polypeptide
DIQMTQSPSSLSASVGDRVTITCRASKFIRDELYWYQQKPGKAPRLLIGGSSLLQSGVPSRFSGSGSGTDFTLTISSLQPEDFATYYCGQLWRAPATFGQGTKVEIKR

SEQ ID NO: 8605 - protein, 108 aa, Artificial Sequence
  Description of Artificial Sequence: Synthetic polypeptide
DIQMTQSPSSLSASVGDRVTITCRASKPIYGGLEWYQQKPGKAPRLLIGGGSVLQSGVPSRFSGSGSGTDFTLTISSLQPEDFATYYCGQVWGGPVTFGQGTKVEIKR

SEQ ID NO: 8606 - protein, 108 aa, Artificial Sequence
  Description of Artificial Sequence: Synthetic polypeptide
DIRMTQSPSSLSASVGDRVTITCRASRPISGCLDWYQQKPGKAPKLLIDGASGLQSGVPSRFSGSGSGTDFTLTISSLQPEDFATYYCGQWWEYPPTFGQGTKVEIKR

SEQ ID NO: 8607 - protein, 108 aa, Artificial Sequence
  Description of Artificial Sequence: Synthetic polypeptide
DIQMTQSPSSLSASVGDRVTITCRASKPIVRDLEWYQQKPGKAPKLLIHGVSTLQSGVPSRFSGSGSGTDFTLTISSLQPEDFATYYCGQLEAAPATFGQGTKVEIKR

SEQ ID NO: 8608 - protein, 108 aa, Artificial Sequence
  Description of Artificial Sequence: Synthetic polypeptide
DIQMTQSPSSLSASVGDRVTITCRASRDIGDWLYWYQQKPGKAPRLLIVWASVLQSGVPSRFSGSGSGTDFTLTISSLQPEDFATYYCAQWGTPPTTFGQGTKVEIKR

SEQ ID NO: 8609 - protein, 108 aa, Artificial Sequence
  Description of Artificial Sequence: Synthetic polypeptide
DIQMTQSPSSLSASVGDRVTITCRASNRIEYGLDWYQQKPGKAPKLLISGSSRLQSGVPSRFSSSGSGTDFTLTISSLQPEDFATYYCGQLEAAPATFGQGTKVEIKR

SEQ ID NO: 8610 - protein, 108 aa, Artificial Sequence
  Description of Artificial Sequence: Synthetic polypeptide
DIQMTQSPSSLSASVGDRVTITCRASRNIGHFLDWYQQKPGKAPKLLILGGSSLQSGVPSRFSGSGSGTDFTLTISSLQPEDFATYYCGQLVEPPATFGQGTKVEIKR

SEQ ID NO: 8611 - protein, 108 aa, Artificial Sequence
  Description of Artificial Sequence: Synthetic polypeptide
DIQMTQSPSSLSASVGDRVTITCRASSSIYSDLYWYQQKPGKAPKLLIDGWSGLQSGVPSRFSGSGSGTDFTLTISSLQPEDFATYYCGQLHRAPATFGQGTKVEIKR

SEQ ID NO: 8612 - protein, 108 aa, Artificial Sequence
  Description of Artificial Sequence: Synthetic polypeptide
DIQMTQSPSSLSASVGDRVTITCRASRFITDRLDWYQQKPGKAPKLLIGGVSGLQSGVPSRFSGSGSGTDFTLTISSLQPEDFATYYCGQSSELPWTFGQGTKVEIKR

SEQ ID NO: 8613 - protein, 108 aa, Artificial Sequence
  Description of Artificial Sequence: Synthetic polypeptide
DIQMTQSPSSLSASVGDRVTITCRASRKIGSELYWYQQKPGKAPKLLIGGRSRLQSGVPSRFSGSGSGTDFTLTISSLQPEDFATYYCGQLWEPPATFGQGTKVEIKR

SEQ ID NO: 8614 - protein, 108 aa, Artificial Sequence
  Description of Artificial Sequence: Synthetic polypeptide
DIQMTQSPSSLSASVGDRVTITCRASRNIGNGLDWYQQKPGKAPKLLIGEGSRLQSGVPSRFSGSGSGTDFTLTISSLQPEDFATYYCGQLWHTPPTFGQGTKVEIKR

SEQ ID NO: 8615 - protein, 108 aa, Artificial Sequence
  Description of Artificial Sequence: Synthetic polypeptide
DIQMTQSPSSLSASVGDRVTITCRASRNIYGWLSWYQQKPGKAPRLLIGGWSGLQSGVPSRFSGSGSGTDFTLTISSLQPEDFATYYCAQDYTLPGTFGQGTKVEIKR

SEQ ID NO: 8616 - protein, 108 aa, Artificial Sequence
  Description of Artificial Sequence: Synthetic polypeptide
DIQMTQSPSSLSASVGDRVTITCRASQDIKDWLHWYQQKPGKAPKLLIYFASGLQSGVPSRFSGSGSGTDFTLTISSLQPEDSATYYCQQHYSTPYTSGQGTKVEIKR

SEQ ID NO: 8617 - protein, 108 aa, Artificial Sequence
  Description of Artificial Sequence: Synthetic polypeptide
DIQMTQSPPSLSASVGDRVTITCRASQLISSHLDWYQQKPGKAPKLLVYDASELQSGVPSRFSGSGSGTDFTLTISSLQPEDFATYYCQQHRSLPFTFGQGTKVEIKR

SEQ ID NO: 8618 - protein, 108 aa, Artificial Sequence
  Description of Artificial Sequence: Synthetic polypeptide
DIQMTQSPSSLSASVGDRVTITCRASQWIGGALAWYQQKPGKAPRLLIYQISVLQSGIPSRFSGSGSGTDFTLTISSLQPEDFATYYCQQYIRSPFTFGQGTKVEIKR

SEQ ID NO: 8619 - protein, 108 aa, Artificial Sequence
  Description of Artificial Sequence: Synthetic polypeptide
DIQMTQSPSSLSASVGDRVTITCRASQSIGAALNWYQQKPGKAPKLLIYGLSSLQSGVPSRFSGSGSGTDFTLTISSLQPEDFATYYCQQLFRLPLTFGQGTKVEIKR

SEQ ID NO: 8620 - protein, 108 aa, Artificial Sequence
  Description of Artificial Sequence: Synthetic polypeptide
DIQMTQSPSSLSASVGDRVTITCRASQPIGGRLVWYQQKPGKAPKLLIYGSSILQSGVPSRFSGSGSGTDFTLTISSLQPEDFATYYCQQYAEAPITFGQGTKVEIKR

SEQ ID NO: 8621 - protein, 108 aa, Artificial Sequence
  Description of Artificial Sequence: Synthetic polypeptide
DIQMTQSPSSLSASVGDRVTITCRASQNIGSSLIWYQQKPGKAPTLLIYYSSKLQSGVPSRFSGSGSGTDFTLTISSLQPEDFATYYCQQSLSSPYTVGQGTKVEIKR

SEQ ID NO: 8622 - protein, 108 aa, Artificial Sequence
  Description of Artificial Sequence: Synthetic polypeptide
DIQMTQSPSSLSASVGDRVTITCRASQWIGSELAWYQQKPGKAPKLLIYWTSNLQSGVPSRFSGSGSGTDFTLTISNLQPEDFATYYCQQILETPLTFGQGTKVEIKR

SEQ ID NO: 8623 - protein, 108 aa, Artificial Sequence
  Description of Artificial Sequence: Synthetic polypeptide
DIQMTQSPSSLSASVGDRVTITCRASQKIWDALYWYQQKPGKAPKLLIYRGSILQSGVPSRFSGSGSGTDFTLTISSLQPEDFATYYCQQFYRWPHTFGQGTKVEIKR

SEQ ID NO: 8624 - protein, 108 aa, Artificial Sequence
  Description of Artificial Sequence: Synthetic polypeptide
DIQMTQSPSSLSASVGDRVTITCRASQHIEDSLRWYQQKPGKAPKLLIYYGSVLQSGVPSRFSGSGSGTDFTLTISSLQPEDFATYYCQQMYKFPITFGQGTKVEIKR

SEQ ID NO: 8625 - protein, 108 aa, Artificial Sequence
  Description of Artificial Sequence: Synthetic polypeptide
DIQTTQSPSSLSASVGDRVTITCRASQRINSSLLWYQQKPGKAPKLLIYDTSTLQSGVPSRFSGSRSGTDFTLTISSLQPEDFATYYCQQIWGSPPTFGQGTKVEIKR

SEQ ID NO: 8626 - protein, 108 aa, Artificial Sequence
  Description of Artificial Sequence: Synthetic polypeptide
DIQMTQSPSSLSASVGDRVTITCRASQSIPVGLNWYQQKPGKAPRLLIYSGSTLQSGVPSRFSGSGSGTDFTLTISSLQPEDFATYYCQQDWYYPNTFGQGTKVEIKR

SEQ ID NO: 8627 - protein, 108 aa, Artificial Sequence
  Description of Artificial Sequence: Synthetic polypeptide
DIQMTQSPSSLSASVGDRVTITCRASQPIYGWLNWYQQKPGKAPKLLIYLTSGLQSGVPSRFSGSGSGTDFTLTISSLQPEDFATYYCQQIHSSPFTFGQGTKVEIKR

SEQ ID NO: 8628 - protein, 108 aa, Artificial Sequence
  Description of Artificial Sequence: Synthetic polypeptide
DIQMTQSPSSLSASVGDRVTITCRASQFIDTSLEWYQQKPGKAPKLLIYDGSHLQSGVPSRFSGSGSGTDFTLTISSLQPEDLATYYCQQYWVLPLTFGQGTKVEIKR

SEQ ID NO: 8629 - protein, 108 aa, Artificial Sequence
  Description of Artificial Sequence: Synthetic polypeptide
DIQMTQSPSSLSASVGDRVTITCRASQDIGDALFWYQQKPGKAPKLLIYYSSMLQSGVPSRFSGGGSGTDFTLTISSLQPEDFATYYCQQRHSTPATFGQGTKVEIKR

SEQ ID NO: 8630 - protein, 108 aa, Artificial Sequence
  Description of Artificial Sequence: Synthetic polypeptide
DIQMTQSPSSLSASVGDRVTITCRASQDIDESLMWYQQKPGKAPRLLIYGVSYLQSGVPSRFSGSGSGTDFTLTISSLQPEDFATYYCQQRWKAPFTFGQGTKVEIKR

SEQ ID NO: 8631 - protein, 108 aa, Artificial Sequence
  Description of Artificial Sequence: Synthetic polypeptide
DIQMTQSPSSLSASVGDRVTITCRASQEIVEDLYWYQQKPGKAAKLLIYGASWLQSGVPSRFSGSGSGTDFTLTISSLQPEDFATYYCQQTRRRPYTFGQGTKVEIKR

SEQ ID NO: 8632 - protein, 108 aa, Artificial Sequence
  Description of Artificial Sequence: Synthetic polypeptide
DIQMTQSPASLSASVGDRVTITCRASQDIDPMLRWYQQKPGKAPKLLIYAGSILQSGVPSRFSGSGSGTDFTLTISSLQPEDFATYYCQQTLVTPYTFGQGTKVEIKR

SEQ ID NO: 8633 - protein, 108 aa, Artificial Sequence
  Description of Artificial Sequence: Synthetic polypeptide
DIQMTQSPSSLSASVGDRVTITCRASQSISDALFWYQQKPGKAPRLLIYYGSVLQSGVPSRFSGSGSGTDFTLTISSLQPEDFATYYCQQRFQEPVTFGQGTKVEIKR

SEQ ID NO: 8634 - protein, 108 aa, Artificial Sequence
  Description of Artificial Sequence: Synthetic polypeptide
DIQMTQSPSSLSASVGDRVTITCRASQQISDELNWYQQKPGKAPKLLIYAVSILQSGVPSRFSGSGSGTDFTLTISSLQPEDFATYYCQQWLSFPSTFGQGTKVEIKR

SEQ ID NO: 8635 - protein, 108 aa, Artificial Sequence
  Description of Artificial Sequence: Synthetic polypeptide
DIQMTQSPSSLSASVGDRVTITCRASQNIKHSLRWYQQKPGKAPRLLIYHRSQLQSGVPSRFSGSGSGTDFTLTISSLQPEDFATYYCQQVRHRPYTFGQGTKVEIKR

SEQ ID NO: 8636 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQVALFPYTFGQGTKVEIKR

SEQ ID NO: 8637 - protein, 108 aa, Artificial Sequence
  Description of Artificial Sequence: Synthetic polypeptide
DIQMTQSPSSLSASVGDRVTITCRASQHIGHHLRWYQQKPGKAPKLLIYHRSHLQSGVPSRFSGSGSGTDFTLTISSLQPEDSATYYCQQWDRPPYTFGQGTKVEIKR

SEQ ID NO: 8638 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQVRAVPYTFGQGTKVEIKR

SEQ ID NO: 8639 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQVRFSPYTFGQGTKVEIKR

SEQ ID NO: 8640 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQSYARPVTFGQGTKVEIKR

SEQ ID NO: 8641 - protein, 108 aa, Artificial Sequence
  Description of Artificial Sequence: Synthetic polypeptide
DIQMTQSPSSLSASVGDRVTITCRASQSINHRLYWYQQKPGKAPKLLIYHRSRLQSGVPSRFSGSGSGTDFTLTISSLQPEDFATYYCQQYKVRPNTFGQGTKVEIKR

SEQ ID NO: 8642 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQTYSSPHTFGQGTKVEIKR

SEQ ID NO: 8643 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQRAVRPFTFGQGTKVEIKR

SEQ ID NO: 8644 - protein, 108 aa, Artificial Sequence
  Description of Artificial Sequence: Synthetic polypeptide
DIQMTQSPSSLSASVGDRVTITCRASQAIGHRLRWYQQKPGKAPKLLIYHRSKLQSGVPSRFSGSGSGTDFTLTISSLQPEDFATYYCQQTYYRPLTFGQGTKVEIKR

SEQ ID NO: 8645 - protein, 108 aa, Artificial Sequence
  Description of Artificial Sequence: Synthetic polypeptide
DIQMTQSPASLSASVGDRVTITCRASQDIDPMLRWYQQKPGKAPKLLIYAGSILQSGVPSRFSGSGSGTDFTLTISSLQPEDFATYYCQQTSIRPYTFGQGTKVEIKR

SEQ ID NO: 8646 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSGSGTDFTLTISSLQPEDFATYYCQQYWAFPVTFGQGTKVEIKR

SEQ ID NO: 8647 - protein, 108 aa, Artificial Sequence
  Description of Artificial Sequence: Synthetic polypeptide
DIQMTQSPSSLSASVGDRVTITCRASQPIGPDILWYQQKPGKAPKLLIYQTSILQSGVPSRFSGSESGTDFTLTISSLQPEDFATYYCQQYWAFPVTFGQGTKVEIKR

SEQ ID NO: 8648 - protein, 108 aa, Artificial Sequence
  Description of Artificial Sequence: Synthetic polypeptide
DIQITQSPSSLSASVGDRVTITCRASQPIGPDLLWYQQKPGKAPKLLIYQTSILRSGVPSRFSGSGSGTDFTLTISSLQPEDLATYYCQQYWAFPVTFGQGTKVEIKR

SEQ ID NO: 8649 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGRGSGTDFTLTISSLQPEDFATYYCQQYWAFPVTFGQGTKVEIKR

SEQ ID NO: 8650 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSGTDFTLTISSLQPEDFATYYCQQYWTFPVTFGQGTKVEIKR

SEQ ID NO: 8651 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPEDFATYYCQQYWAFPVTFGQGTKVVIKR

SEQ ID NO: 8652 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPEDLATYYCQQYWAFPVTFGKGTKVVIKR

SEQ ID NO: 8653 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPEDFATYYCQQYWAFPVTFGRGTKVVIKR

SEQ ID NO: 8654 - protein, 108 aa, Artificial Sequence
  Description of Artificial Sequence: Synthetic polypeptide
DIQMTQSPSSLSASVGDRVTITCRASQPIGPDLLWYRQKPGKAPKLLIYQTSILRSGVPSRFSGSGSETDFTLTISNLQPEDFATYYCQQYWAFPVTFGQGTKVVIKR

SEQ ID NO: 8655 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSIMRSGVPSRFSGSGSETDFTLTISNLQPEDFATYYCQQYWTFPVTFGQGTKVEIKR

SEQ ID NO: 8656 - protein, 108 aa, Artificial Sequence
  Description of Artificial Sequence: Synthetic polypeptide
DIQMTQSPSSLSAYVGDRVTITCRASQPIGPDLLWYQQKPGKAPKLLIYQTSILRSGVPSRFSGSGSETDFTLTISNLQPEDFAKYYCQQYWAFPVTFGQGTKVVIKR

SEQ ID NO: 8657 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSETDFTLTISNLQPVDFATYYCQQYWAFPVTFGQGTKVVIKR

SEQ ID NO: 8658 - protein, 108 aa, Artificial Sequence
  Description of Artificial Sequence: Synthetic polypeptide
DIQMTQSPSSLSASVGDRVTITCRASQPIGPDLLWFQQKPGKAPKLLIYQTSILQSGVPSRFSGSESGTDFTLTISSLQPEDFATYYCQQYWAFPVTFGQGTKVEIKR

SEQ ID NO: 8659 - protein, 108 aa, Artificial Sequence
  Description of Artificial Sequence: Synthetic polypeptide
DIQMTQSPSSLSASVGDRVTITCRASQPIGPDLLWYRQKPGKAPKLLIYQTSILQSGVPSRFSGSGSGTDFTLTISSLQPEDFATYYCQQYWTFPVTFGQGTKVEIKR

SEQ ID NO: 8660 - protein, 108 aa, Artificial Sequence
  Description of Artificial Sequence: Synthetic polypeptide
DIQMTQSPSSLSASVGDRVTITCRASQPIDPDLLWYQQKPGKAPKLLIYQTSILQSGVPSRFSGSGSGTVFTLTISSLQPEDFATYYCQQYWAFPVTFGQGTKVEIKR

SEQ ID NO: 8661 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSGTDFTLTISSLQPEDFATYYCQQYWAFPVTFGQGTKVEIKR

SEQ ID NO: 8662 - protein, 108 aa, Artificial Sequence
  Description of Artificial Sequence: Synthetic polypeptide
DIQMTQSPSSLSASVGDRVTITCRASQPIEPDLLWYQQKPGKAPKLLIYQTSILQSGVPSRFSGSGSGTDFTLTISSLQPEDFATYYCQQYWASPVTFGQGTKVEIKR

SEQ ID NO: 8663 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSESGTDFTLTISSLQPEDIATYYCQQYWAFPVTFGQGTRVEIKR

SEQ ID NO: 8664 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSESGTDFTLTISSLQPEDFATYYCQQYWAFPVTFGQGTKVEIKR

SEQ ID NO: 8665 - protein, 108 aa, Artificial Sequence
  Description of Artificial Sequence: Synthetic polypeptide
DIQMTQSPSSLSASVGDRVAITCRASQPIGPDILWYQQKPGKAPKLLIYQTSILRSGVPSRFSGSGSGTDFTLTISSLQPEDSATYYCQQYWAFPVTFGQGTKVEIKR

SEQ ID NO: 8666 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILRSGVPSRFSGSGSVTDFTLTISSLQPEDFATYYCQQYWAFPVTFGQGTKVGIKR

SEQ ID NO: 8667 - protein, 108 aa, Artificial Sequence
  Description of Artificial Sequence: Synthetic polypeptide
DIQMTQSPSSLSASVGDRVTITCRASQPIDPDLLWYQQKPGKAPKLLIYQTSILQSGVPSRFSGSGSRTDFTLTISSLQPEDFATYYCQQYWAFPVTFGQGTKVEIKR

SEQ ID NO: 8668 - protein, 108 aa, Artificial Sequence
  Description of Artificial Sequence: Synthetic polypeptide
DIQMTQSPSSLSASVGDRVTITCRASQPIGPDLLWYQQKPGKAPKLLIYQTSILQSGVPSRFSGSGSGTDFTLTISGLQPEDFATYYCQQYWAFPVTFGQGTKVEIKR

SEQ ID NO: 8669 - protein, 108 aa, Artificial Sequence
  Description of Artificial Sequence: Synthetic polypeptide
DIQMTQSPSSLSASVGDRVTITCRASMPIGPDLLWYQQKPGKAPKLLIYQTSILRSGVPSRFSGSESGTDFTLTISSLQPEDFATYYCQQYWAFPVTFGQGTKVEIKR

SEQ ID NO: 8670 - protein, 108 aa, Artificial Sequence
  Description of Artificial Sequence: Synthetic polypeptide
DIQMTQSPSSLSASVGDRVTITCRASQWIGDTLTWYQQKLGKAPKLLIYGGSELQSGVPPRFSGSGSGTDFTLTISSLQPEDFATYYCQQCISSPCTFGQGTKVEIKR

SEQ ID NO: 8671 - protein, 108 aa, Artificial Sequence
  Description of Artificial Sequence: Synthetic polypeptide
DIQMTQSPSSLSASVGDRVTITCRASQFIGDSLSWYQQKPGKAPKLLIYFSSILQSGVPSRFSGSGSGTDFTLTISSLQPEDFATYYCQQYHTSPTTFGRGTKVKIKR

SEQ ID NO: 8672 - protein, 108 aa, Artificial Sequence
  Description of Artificial Sequence: Synthetic polypeptide
DIQMTQSPSSLSASVGDRVTITCRASQTIETNLEWYQQKPGKAPKLLIYDSSQLQSGVPSRFSGSGSGTDFTLTISSLQPEDLATYYCQQYHGYPTTFGQGTKVEIKR

SEQ ID NO: 8673 - protein, 108 aa, Artificial Sequence
  Description of Artificial Sequence: Synthetic polypeptide
DIQMTQSPSSLSASVGDRVTITCRASQMIDQDLEWYQQKPGKAPKLLIYNASWLQSGVPSRFSGSGSGTDFTLTISSLQPEDFATYYCQQYHGYPITFGQGTKVEIKR

SEQ ID NO: 8674 - protein, 108 aa, Artificial Sequence
  Description of Artificial Sequence: Synthetic polypeptide
DIQMTQSPSSLSASVGDRVTITCRASQTIYTSLSWYQQKPGKAPKLLIHYGSVLQSGVPSRFSGSGSGTDFTLTISSLQPEDSATYYCQQVHQAPTTFGQGTKVEIKR

SEQ ID NO: 8675 - protein, 108 aa, Artificial Sequence
  Description of Artificial Sequence: Synthetic polypeptide
DIRMTQSPSSLSASVGDRVTITCRASQWIGDSLAWYQQKPGKAPKLLIYGISELQSGVPSRFSGSGSGTDFTLTISSLQPEDSATYYCQLSSSMPHTFGQGTKVEIKR

SEQ ID NO: 8676 - protein, 108 aa, Artificial Sequence
  Description of Artificial Sequence: Synthetic polypeptide
DIQMTQSPSSLSASVGDRVTITCRASQEIETNLEWYQQKPGKAPKLLIYDSSHLQSGVPSRFSGSGSGTDFTLTISSLQPEDFATYYCQQYHQNPPTFGQGTKVEIKR

SEQ ID NO: 8677 - protein, 108 aa, Artificial Sequence
  Description of Artificial Sequence: Synthetic polypeptide
DIQMTQSPSSLSASVGDRVTITCRASQWIGRQLVWYQQKPGKAPKLLIYGATELQSGVPSRFSGSGSGTDFTLTISSLQPEDFATYYCQQQSKGPLTFGHGTKVEIKR

SEQ ID NO: 8678 - protein, 108 aa, Artificial Sequence
  Description of Artificial Sequence: Synthetic polypeptide
DIQMTQSPSSLSASVGDRVTITCRASQGIGTDLNWYQQKPGKAPKLLIYMGSYLQSGVPSRFSGSGSGTDFTLTISSLQPEDFATYYCQQIYSFPITFGQGTKVEIKR

SEQ ID NO: 8679 - protein, 108 aa, Artificial Sequence
  Description of Artificial Sequence: Synthetic polypeptide
DIQMTQSPSSLSASVGDRVTITCRASQDIEEMLHWYQQKPGKAPKLLIYFGSLLQSGVPSRFSGSRSGTDFTLTISSLQPEDFATYYCQQHHTRPYTFGQGTKVEIKR

SEQ ID NO: 8680 - protein, 108 aa, Artificial Sequence
  Description of Artificial Sequence: Synthetic polypeptide
DIQMTQSPSSLSASVGDRVTITCRASQDIGMDLEWYQQIPGKVPKLLIYDASYLQSGVPSRFSGSGSGTDFTLTISSLQPEDFATYYCQQYHKLPATFGQGTKVEIKR

SEQ ID NO: 8681 - protein, 108 aa, Artificial Sequence
  Description of Artificial Sequence: Synthetic polypeptide
DIQMTQSPSSLSASVGDRVTITCRASQDIMDNLEWYQQKPGKAPKLLIYAASWLQSGVPSRFSGSGSGTDFTLTISSLQPEDFATYYCQQYHKLPVTFGQGTKVEIKR

SEQ ID NO: 8682 - protein, 107 aa, Artificial Sequence
  Description of Artificial Sequence: Synthetic polypeptide
SIVMTQSPSSLSASVGDRVTITCKASQSVTNDVAWYQQKPGKAPKLLIYYASNRYTGVPDRFSGSGYGTDFTFTISSLQPEDIATYYCQQDYSSPYTFGQGTKVEIK

SEQ ID NO: 8683 - protein, 107 aa, Artificial Sequence
  Description of Artificial Sequence: Synthetic polypeptide
DIQMTQSPSSLSASVGDRVTITCKASQSVTNDVAWYQQKPGKAPKLLIYYASNRYTGVPDRFSGSGSGTDFTFTISSLQPEDIATYYCQQDYSSPYTFGQGTYVEIK

SEQ ID NO: 8684 - protein, 107 aa, Artificial Sequence
  Description of Artificial Sequence: Synthetic polypeptide
SIVMTQSPDSLAVSLGERVTINCKASQSVTNDVAWYQQKPGQSPKLLIYYASNRYTGVPDRFSGSGYGTDFTFTISSVQAEDVAVYYCQQDYSSPYTFGGGTKLEIK

SEQ ID NO: 8685 - protein, 106 aa, Artificial Sequence
  Description of Artificial Sequence: Synthetic polypeptide
DIQMTQSPSSLSASVGDRVTITCKTSQDINKYMAWYQQTPGKAPRLLIYYTSALQPGIPSRFSGSGSGRDYTFTISSLQPEDIATYYCLQYDNLWTFGQGTEVEIK

SEQ ID NO: 8686 - protein, 107 aa, Artificial Sequence
  Description of Artificial Sequence: Synthetic polypeptide
DIKMTQSPSFLSASVGDRVTLNCKASQNIDKYLNWYQQKLGESPKLLIYNTNNLQTGIPSRFSGSGSGTDFTLTISSLQPEDVATYFCLQHISRPRTFGTGTKLELK

SEQ ID NO: 8687 - protein, 113 aa, Artificial Sequence
  Description of Artificial Sequence: Synthetic polypeptide
DIVMTQTPLSLSVTPGQPASISCRSSQSLVHTNGNTYLHWYLQKPGQSPQLLIYMVSNRFSGVPDRFSGSGSGTDFTLKISRVEAEDVGVYYCSQSAHVPPLTFGQGTRLEIK

SEQ ID NO: 8688 - protein, 112 aa, Artificial Sequence
  Description of Artificial Sequence: Synthetic polypeptide
DVVMTQTPLALSVTIGHPASISCKSSQSLLESDGRTYLNWLFQRPGQSPKRLIYLVSNLDSGVPDRFSGSGSGTDFTLKISRVEAEDLGVYYCWQGTHFPWTFGGGTKLELK

SEQ ID NO: 8689 - protein, 114 aa, Artificial Sequence
  Description of Artificial Sequence: Synthetic polypeptide
DIVLTQSPDSLAVSLGERATINCKSSQSVLYSSNNKNYLAWYQQKPGQPPKLLIYWASTRESGVPDRFSGSGSGTDFTPAISSLQAEDVAVYYCQQYYSTPQLTFGGGTKVDIK

SEQ ID NO: 8690 - protein, 109 aa, Artificial Sequence
  Description of Artificial Sequence: Synthetic polypeptide
SSELTQEPAVSVALGQTVSITCQGDSLRSYYASWYQQKPGQAPIPVIYGKNNRPSGIPDRFSGSSSGNTASLTITGAQAEDEADYYCSSRDNRGTHRWVFGGGTKLTVL

SEQ ID NO: 8691 - protein, 94 aa, Artificial Sequence; identical to SEQ ID NO: 8375
  Description of Artificial Sequence: Synthetic polypeptide

SEQ ID NO: 8692 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASSRATGIPARFGGSGSGTDFTLTISSLEPEDFAVYYCQLRSNWPPYTFGQGTKLEIK

SEQ ID NO: 8693 - protein, 111 aa, Artificial Sequence; identical to SEQ ID NO: 6320
  Description of Artificial Sequence: Synthetic polypeptide

SEQ ID NO: 8694 - protein, 113 aa, Artificial Sequence; identical to SEQ ID NO: 6321
  Description of Artificial Sequence: Synthetic polypeptide

SEQ ID NO: 8695 - protein, 111 aa, Artificial Sequence
  Description of Artificial Sequence: Synthetic polypeptide
DVVMTQTPLSLPVSLGDQASISCRSSQSLVHRNGNTYLHWYLQKPGQSPKLLIYTVSNRFSGVPDRFSGSGSGTDFTLKISRVEAEDLGLYFCSQSSHVPPTFGAGTKLEI

SEQ ID NO: 8696 - protein, 113 aa, Artificial Sequence
  Description of Artificial Sequence: Synthetic polypeptide
DIQLTQTPLSLPVSLGDQASISCRSSQSLVHRNGNTYLHWYLQKPGQSPKLLIYTVSNRFSGVPDRFSGSGSGTDFTLKISRVEAEDLGLYFCSQSSHVPPTFGAGTKLEIKR

SEQ ID NO: 8697 - protein, 111 aa, Artificial Sequence; identical to SEQ ID NO: 8695
  Description of Artificial Sequence: Synthetic polypeptide

SEQ ID NO: 8698 - protein, 113 aa, Artificial Sequence; identical to SEQ ID NO: 8696
  Description of Artificial Sequence: Synthetic polypeptide

SEQ ID NO: 8699 - protein, 120 aa, Artificial Sequence; identical to SEQ ID NO: 6314
  Description of Artificial Sequence: Synthetic polypeptide

SEQ ID NO: 8700 - protein, 111 aa, Artificial Sequence; identical to SEQ ID NO: 8695
  Description of Artificial Sequence: Synthetic polypeptide

SEQ ID NO: 8701 - protein, 113 aa, Artificial Sequence; identical to SEQ ID NO: 8696
  Description of Artificial Sequence: Synthetic polypeptide

SEQ ID NO: 8702 - protein, 111 aa, Artificial Sequence; identical to SEQ ID NO: 6320
  Description of Artificial Sequence: Synthetic polypeptide

SEQ ID NO: 8703 - protein, 113 aa, Artificial Sequence; identical to SEQ ID NO: 6321
  Description of Artificial Sequence: Synthetic polypeptide

SEQ ID NO: 8704 - protein, 107 aa, Artificial Sequence
  Description of Artificial Sequence: Synthetic polypeptide
DIQMTQSPSSLSASVGDRVTITCRASQGISSWLAWFQQKPEKAPKSLIYAASSLQSGVPSRFSGSGSGTDFTLTISSLQPEDFATYYCQQYNSYPLTFGGGTKVEIK

SEQ ID NO: 8705 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 8706 - protein, 107 aa, Artificial Sequence; identical to SEQ ID NO: 8206
  Description of Artificial Sequence: Synthetic polypeptide

SEQ ID NO: 8707 - protein, 106 aa, Artificial Sequence
  Description of Artificial Sequence: Synthetic polypeptide
DIQMTQSPSSLSASVGDRVTITCRASEDVNTYVSWYQQKPGKAPKLLIYAASNRYTGVPSRFSGSGSGTDFTLTISSLQPEDFATYYCQQSFSYPTFGQGTKLEIK

SEQ ID NO: 8708 - protein, 108 aa, Artificial Sequence
  Description of Artificial Sequence: Synthetic polypeptide
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 8709 - DNA, 325 bp, Artificial Sequence
  Description of Artificial Sequence: Synthetic polynucleotide
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcattcagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaac

SEQ ID NO: 8710 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKVEIK

SEQ ID NO: 8711 - protein, 108 aa, Artificial Sequence; identical to SEQ ID NO: 8708
  Description of Artificial Sequence: Synthetic polypeptide

SEQ ID NO: 8712 - protein, 108 aa, Artificial Sequence
  Description of Artificial Sequence: Synthetic polypeptide
EIVLTQSPGTLSLSPGERATLSCRASQSVSSSFLAWYQQKPGQAPRLLIYGASSRATGIPDRFSGSGSGTDFTLTISRLEPEDFAVYYCQQYGSSPWTFGQGTKVEIK

SEQ ID NO: 8713 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIK

SEQ ID NO: 8714 - protein, 119 aa, Artificial Sequence
  Description of Artificial Sequence: Synthetic polypeptide
DIVLTQSPATLSVTPGDSVSLSCRASQSISNNLHWYQQKSHESPRLLINYASQSISGIPSRFSGSGSGTDFTLSINSVETEDFGMYFCQQSNSWPLTFGAGTKLELKRRASQSISNNLH

SEQ ID NO: 8715 - protein, 119 aa, Artificial Sequence
  Description of Artificial Sequence: Synthetic polypeptide
DIVLTQSPATLSVTPGDSVSLSCRASQSISNNLHWYQQKSHESPRLLITYASQSISGIPSRFSGSGSGTDFTLSINSVESEDVGVYFCQQSDSWPLTFGAGTKLELKRRASQSISNNLH

SEQ ID NO: 8716 - protein, 119 aa, Artificial Sequence
  Description of Artificial Sequence: Synthetic polypeptide
DIQMTQTTSSLSASLGDRVTISCRSSQDISNFLNWYQQRPDGTVKLLIYYTSRLHSGVPSRFSGSGSGTDYSLTISNLEQEDIATYFCQQGDTLPWTFGGGTKLEIKRRSSQDISNFLN

SEQ ID NO: 8717 - protein, 119 aa, Artificial Sequence
  Description of Artificial Sequence: Synthetic polypeptide
DIVLTQSPATLSVTPGDSVSLSCRASQSISNNLHWYQQRSHESPRLIITHVSQSISGIPSRFSGSGSGTDFIFSINSVESEDFGVYFCQQSNSWPLTFGAGTKLELKRRASQSISNNLH

SEQ ID NO: 8718 - protein, 119 aa, Artificial Sequence
  Description of Artificial Sequence: Synthetic polypeptide
DIVLTQSPATLSVTPGDSVSLSCRASQNINNNLHWYQQKSHESPRLLITYTSQSISGIPSRFSGSGSGTDFTLSINSVESEDVGVYFCQQSDSWPLTFGAGTKLELKRRASQNINNNLH

SEQ ID NO: 8719 - protein, 119 aa, Artificial Sequence
  Description of Artificial Sequence: Synthetic polypeptide
DIVLTQSPATLSVTPGDSVSLSCRASQSINNNLHWYQQESHESPRLLITYASQSISGIPSRFSGSGSGTDFTLSINSVESEDFGVYFCQQSNSWPLTFGAGTKLELKRRASQSINNNLH

SEQ ID NO: 8720 - protein, 119 aa, Artificial Sequence
  Description of Artificial Sequence: Synthetic polypeptide
DIVLTQSPATLSVTPGDSVSLSCRASQSISSNLHWYQQKSHESPRLLITYASQSISGIPSRFSGSGSGTDFTLSINSVESEDVGVYFCQQSDSWPLTFGAGTKLELKRRASQSISSNLH

SEQ ID NO: 8721 - protein, 119 aa, Artificial Sequence; identical to SEQ ID NO: 8720
  Description of Artificial Sequence: Synthetic polypeptide

SEQ ID NO: 8722 - protein, 109 aa, Artificial Sequence
  Description of Artificial Sequence: Synthetic polypeptide
DIQMTQSPSSLSASVGDRVTITCRASQGIKNYLNWYQQKPGKAPKLLIGAASSLQSGVPSRFSGSGSGTDFTLTISSLQPEDFATYYCLQYYGMPPTFGQGTKVEIKRT

SEQ ID NO: 8723 - protein, 109 aa, Artificial Sequence
  Description of Artificial Sequence: Synthetic polypeptide
DIQMTQSPSSLSASVGDRVTITCRASQDISNYLHWYQQKPGKAPKLLIYGASNLQSGVPSRFSGSGSGTDFTLTISSLQPEDFAVYYCQQYDSIPMTFGQGTKVEIKRT

SEQ ID NO: 8724 - protein, 110 aa, Artificial Sequence
  Description of Artificial Sequence: Synthetic polypeptide
DIVLTQSPATLSLSPGERATLSCRASQNLFSPYLAWYQQKPGQAPRLLIYGASNRATGVPARFSGSGSGTDFTLTISSLEPEDFATYYCQQYGDEPITFGQGTKVEIKRT

SEQ ID NO: 8725 - protein, 112 aa, Artificial Sequence
  Description of Artificial Sequence: Synthetic polypeptide
DIALTQPASVSGSPGQSITISCTGTSSDVGGFNYVSWYQQHPGKAPKLMIHDGSNRPSGVSNRFSGSKSGNTASLTISGLQAEDEADYYCSTWDMTVDFVFGGGTKLTVLGQ

SEQ ID NO: 8726 - protein, 113 aa, Artificial Sequence
  Description of Artificial Sequence: Synthetic polypeptide
DIALTQPASVSGSPGQSITISCTGTSSDLGGYNYVSWYQQHPGKAPKLMIYDVNNRPSGVSNRFSGSKSGNTASLTISGLQAEDEADYYCQSYASGNTKVVFGGGTKLTVLGQ

SEQ ID NO: 8727 - protein, 112 aa, Artificial Sequence
  Description of Artificial Sequence: Synthetic polypeptide
DIVLTQPPSVSGAPGQRVTISCSGSSSNIGSSFVNWYQQLPGTAPKLLIGNNSNRPSGVPDRFSGSKSGTSASLAITGLQSEDEADYYCASFDMGSPNVVFGGGTKLTVLGQ

SEQ ID NO: 8728 - protein, 110 aa, Artificial Sequence
  Description of Artificial Sequence: Synthetic polypeptide
DIVLTQSPATLSLSPGERATLSCRASQNLFSPYLAWYQQKPGQAPRLLIYGASNRATGVPARFSGSGSGTDFTLTISSLEPEDFAVYYCQQYLSLPTTFGQGTKVEIKRT

SEQ ID NO: 8729 - protein, 110 aa, Artificial Sequence
  Description of Artificial Sequence: Synthetic polypeptide
DIVLTQSPATLSLSPGERATLSCRASQNLFSPYLAWYQQKPGQAPRLLIYGASNRATGVPARFSGSGSGTDFTLTISSLEPEDFAVYYCQQYMTLPLTFGQGTKVEINRT

SEQ ID NO: 8730 - protein, 110 aa, Artificial Sequence
  Description of Artificial Sequence: Synthetic polypeptide
DIVLTQSPATLSLSPGERATLSCRASQNLFSPYLAWYQQKPGQAPRLLIYGASNRATGVPARFSGSGSGTDFTLTISSLEPEDFAVYYCQQYLTLPLTFGQGTKVEIKRT

SEQ ID NO: 8731 - protein, 113 aa, Artificial Sequence
  Description of Artificial Sequence: Synthetic polypeptide
DIALTQPASVSGSPGQSITISCTGTSSDVGGFNYVSWYQQHPGKAPKLMIHDGSNRPSGVSNRFSGSKSGNTASLTISGLQAEDEADYYCQSWDVSPITAVFGGGTKLTVLGQ

SEQ ID NO: 8732 - protein, 113 aa, Artificial Sequence
  Description of Artificial Sequence: Synthetic polypeptide
DIALTQPASVSGSPGQSITISCTGTSSDVGGFNYVSWYQQHPGKAPKLMIHDGSNRPSGVSNRFSGSKSGNTASLTISGLQAEDEADYYCQTWATSPLSSVFGGGTKLTVLGQ

SEQ ID NO: 8733 - protein, 112 aa, Artificial Sequence
  Description of Artificial Sequence: Synthetic polypeptide
DIALTQPASVSGSPGQSITISCTGTSSDVGGFNYVSWYQQHPGKAPKLMIHDGSNRPSGVSNRFSGSKSGNTASLTISGLQAEDEADYYCQTWDSLSFFVFGGGTKLTVLGQ

SEQ ID NO: 8734 - protein, 113 aa, Artificial Sequence
  Description of Artificial Sequence: Synthetic polypeptide
DIALTQPASVSGSPGQSITISCTGTSSDLGGYNYVSWYQQHPGKAPKLMIYDVNNRPSGVSNRFSGSKSGNTASLTISGLQAEDEADYYCQSYTYTPISPVFGGGTKLTVLGQ

SEQ ID NO: 8735 - protein, 113 aa, Artificial Sequence; identical to SEQ ID NO: 8726
  Description of Artificial Sequence: Synthetic polypeptide

SEQ ID NO: 8736 - protein, 113 aa, Artificial Sequence
  Description of Artificial Sequence: Synthetic polypeptide
DIALTQPASVSGSPGQSITISCTGTSSDLGGYNYVSWYQQHPGKAPKLMIYDVNNRPSGVSNRFSGSKSGNTASLTISGLQAEDEADYYCQTYDQIKLSAVFGGGTKLTVLGQ

SEQ ID NO: 8737 - protein, 113 aa, Artificial Sequence
  Description of Artificial Sequence: Synthetic polypeptide
DIALTQPASVSGSPGQSITISCTGTSSDLGGYNYVSWYQQHPGKAPKLMIYDVNNRPSGVSNRFSGSKSGNTASLTISGLQAEDEADYYCQSYDSPTDSVVFGGGTKLTVLGQ

SEQ ID NO: 8738 - protein, 113 aa, Artificial Sequence; identical to SEQ ID NO: 8726
  Description of Artificial Sequence: Synthetic polypeptide

SEQ ID NO: 8739 - protein, 112 aa, Artificial Sequence; identical to SEQ ID NO: 8727
  Description of Artificial Sequence: Synthetic polypeptide

SEQ ID NO: 8740 - protein, 110 aa, Artificial Sequence
  Description of Artificial Sequence: Synthetic polypeptide
DIVLTQSPATLSLSPGERATLSCRASQNLFSPYLAWYQQKPGQAPRLLIYGASNRATGVPARFSGSGSGTDFTLTISSLEPEDFAVYYCQQYMTLPLTFGQGTKVEIKRT

SEQ ID NO: 8741 - protein, 118 aa, Artificial Sequence
  Description of Artificial Sequence: Synthetic polypeptide
QVQLVQSGAEVKKPGASVKVSCKASGYTFTNYGMNWVRQAPGQRLEWMGWINTYTGDPTYADDFKGRVTITRDTSASTAYMELSSLRSEDTAVYYCARIGGNSPSDYWGQGTTVTVSS

SEQ ID NO: 8742 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQHRSNWPPTFGGGTKVEIK

SEQ ID NO: 8743 - protein, 108 aa, Artificial Sequence
  Description of Artificial Sequence: Synthetic polypeptide
DIQMTQSPASLSASLGETISIECRASEDIYSNLAWYQKKSGKSPQLLIYAANRLQDGVPSRFSGSGSGTQYSLKISGMQPEDEGDYFCLQGSKFPLTFGSGTKLEIKR

SEQ ID NO: 8744 - protein, 108 aa, Artificial Sequence
  Description of Artificial Sequence: Synthetic polypeptide
DIQMTQSPASLSASLGETVTIECRASEDIYSNLAWYQQKPGNSPQLLIFDTNNLADGVPSRFSGSGSGTQSSLKINSLQSEDVASYFCQQYNNYPPTFGGGTKLELKR

SEQ ID NO: 8745 - protein, 108 aa, Artificial Sequence
  Description of Artificial Sequence: Synthetic polypeptide
DIQMTQSPPVLSASVGDRVTLSCKASQNIHKNLDWYQQKHGDAPKLLIYYTDHLQTGVPSRFSGSGSATDYTLTISSLQPEDVATYYCYQYNGGPFTFGSGTKLEIKR

SEQ ID NO: 8746 - protein, 109 aa, Artificial Sequence
  Description of Artificial Sequence: Synthetic polypeptide
DIQMTQSPASLSASLGETVTIECRASDDIYNGLAWFQQKPGKSPQLLIYDANTLHTGVPSRFSGSGSGTQFSLKINSLQSEDVASYFCQQFYDYPPYTFGAGTKLELKR

SEQ ID NO: 8747 - protein, 108 aa, Artificial Sequence
  Description of Artificial Sequence: Synthetic polypeptide
DTVMTQSPASMSTSVGERVTVNCKASQSVGTIVAWFQQKPGQSPKRLIYLATYRHTGVPDRFIGSGFGRDFTLTISNVEAEDLAVYYCLQYGSRPFTFGAGTKLEIKR

SEQ ID NO: 8748 - protein, 111 aa, Artificial Sequence
  Description of Artificial Sequence: Synthetic polypeptide
NTVLTQSPALAVSLGQRVTISCKASRSVSSPMYSYIYWYQQKPGQQPKLLIYRASTLASGVPARFSGSGSGTDFTLNIDPVEADDIATYFCQQSWSDPFTFGSGTKLEIKR

SEQ ID NO: 8749 - protein, 111 aa, Artificial Sequence
  Description of Artificial Sequence: Synthetic polypeptide
DTVLTQSPALAVSLGQRVTISCKASRSLSSPMYSYIYWYQQKLGQQPRLLIYRASTLASGVPARFSGSGSGTDFTLNIDPVEADDIATYFCQQSWSDPFTFGSGTKLEIKR

SEQ ID NO: 8750 - protein, 108 aa, Artificial Sequence
  Description of Artificial Sequence: Synthetic polypeptide
DIQMTQSPSSLSASVGDRVTITCRASEDIYSNLAWYQQKPGKAPKLLIYDTNNLADGVPSRFSGSGSGTDFTLTISSLQPEDFATYYCQQYNNYPPTFGQGTKLEIKR

SEQ ID NO: 8751 - protein, 108 aa, Artificial Sequence
  Description of Artificial Sequence: Synthetic polypeptide
DIQMTQSPSSLSASVGDRVTITCRASEDIYSNLAWYQQKPGKSPKLLIFDTNNLADGVPSRFSGSGSGTDSTLTISSLQPEDFATYFCQQYNNYPPTFGQGTKLEIKR

SEQ ID NO: 8752 - protein, 108 aa, Artificial Sequence
  Description of Artificial Sequence: Synthetic polypeptide
DIQMTQSPSSLSASVGDRVTITCRASEDIYSNLAWYQQKPGKAPKLLIFDTNNLADGVPSRFSGSGSGTDFTLTISSLQPEDFATYYCQQYNNYPPTFGQGTKLEIKR

SEQ ID NO: 8753 - protein, 108 aa, Artificial Sequence
  Description of Artificial Sequence: Synthetic polypeptide
EIVMTQSPATLSVSPGERATLSCRASEDIYSNLAWYQQKPGQSPRLLIFDTNNLADGVPARFSGSGSGTESTLTISSLQSEDFAVYFCQQYNNYPPTFGQGTKLEIKR

SEQ ID NO: 8754 - protein, 108 aa, Artificial Sequence
  Description of Artificial Sequence: Synthetic polypeptide
DIQMTQSPSSLSASVGDRVTITCRASEDIYSNLAWYQQKPGKAPKLLIYAANRLQDGVPSRFSGSGSGTDFTLTISSLQPEDFATYYCLQGSKFPLTFGQGTKLEIKR

SEQ ID NO: 8755 - protein, 108 aa, Artificial Sequence
  Description of Artificial Sequence: Synthetic polypeptide
DIQMTQSPSSLSASVGDRVTITCRASEDIYSNLAWYQKKPGKSPKLLIYAANRLQDGVPSRFSGSGSGTDYTLTISSLQPEDFATYFCLQGSKFPLTFGQGTKLEIKR

SEQ ID NO: 8756 - protein, 108 aa, Artificial Sequence
  Description of Artificial Sequence: Synthetic polypeptide
DIQMTQSPSSLSASVGDRVTITCRASEDIYSNLAWYQQKPGKAPKLLIYAANRLQDGVPSRFSGSGSGTDYTLTISSLQPEDFATYYCLQGSKFPLTFGQGTKLEIKR

SEQ ID NO: 8757 - protein, 108 aa, Artificial Sequence
  Description of Artificial Sequence: Synthetic polypeptide
EIVMTQSPATLSVSPGERATLSCRASEDIYSNLAWYQKKPGQSPRLLIYAANRLQDGVPARFSGSGSGTEYTLTISSLQSEDFAVYFCLQGSKFPLTFGQGTKLEIKR

SEQ ID NO: 8758 - protein, 107 aa, Artificial Sequence
  Description of Artificial Sequence: Synthetic polypeptide
DIQMTQSPSSLSASVGDRVTITCRASEDIYSNLAWYQQKPGKAPKLLIYDTNNLADGVPSRFSGSGSGTDFTLTISSLQPEDFATYYCQQYNNYPPTFGQGTKLEIK

SEQ ID NO: 8759 - protein, 107 aa, Artificial Sequence
  Description of Artificial Sequence: Synthetic polypeptide
DIQMTQSPSSLSASVGDRVTITCRASQDIYINLAWYQQKPGKSPKLLIFDTNDLADGVPSRFSGSGSGTDFTLTISSLQPEDFATYYCQQYDYVPPTFGQGTKLEIK

SEQ ID NO: 8760 - protein, 107 aa, Artificial Sequence
  Description of Artificial Sequence: Synthetic polypeptide
DIQMTQSPSSLSASVGDRVTITCRASQDIYYNLAWYQQKPGKSPKLLIFDTSSLADGVPSRFSGSGSGTDFTLTISSLQPEDFATYFCQQYDWYPPTFGQGTKLEIK

SEQ ID NO: 8761 - protein, 107 aa, Artificial Sequence
  Description of Artificial Sequence: Synthetic polypeptide
DIQMTQSPSSLSASVGDRVTITCRASQDIYINLAWYQQKPGKAPKLLIFDTSDLADGVPSRFSGSGSGTDFTLTISSLQPEDFATYYCQQYDYYPPTFGQGTKLEIK

SEQ ID NO: 8762 - protein, 107 aa, Artificial Sequence
  Description of Artificial Sequence: Synthetic polypeptide
DIQMTQSPSSLSASVGDRVTITCRASQDIYYNLAWYQQKPGKAPKLLIFDTNILADGVPSRFSGSGSGTDFTLTISSLQPEDFATYFCQQYDYVPPTFGQGTKLEIK

SEQ ID NO: 8763 - protein, 107 aa, Artificial Sequence
  Description of Artificial Sequence: Synthetic polypeptide
DIQMTQSPSSLSASVGDRVTITCRASQDIWNNLAWYQQKPGKSPKLLIFDTSYLADGVPSRFSGSGSGTDFTLTISSLQPEDFATYYCQQYDWYPPTFGQGTKLEIK

SEQ ID NO: 8764 - protein, 107 aa, Artificial Sequence
  Description of Artificial Sequence: Synthetic polypeptide
DIQMTQSPSSLSASVGDRVTITCRASQEIYRNLAWYQQKPGKSPKLLIFDTSVLADGVPSRFSGSGSGTDSTLTISSLQPEDFATYYCQQYTYYPPTFGQGTKLEIK

SEQ ID NO: 8765 - protein, 113 aa, Artificial Sequence
  Description of Artificial Sequence: Synthetic polypeptide
DIQMTQSPSSLSASVGDRVTITCRTSQSLVHINAITYLHWYQQKPGKAPKLLIYRVSNRFSGVPSRFSGSGSGTDFTLTISSLQPEDFATYYCGQSTHVPLTFGQGTKVEIKR

SEQ ID NO: 8766 - protein, 105 aa, Artificial Sequence
  Description of Artificial Sequence: Synthetic polypeptide
TITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQ

SEQ ID NO: 8767 - protein, 108 aa, Artificial Sequence
  Description of Artificial Sequence: Synthetic polypeptide
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRT

SEQ ID NO: 8768 - protein, 107 aa, Artificial Sequence [sequence omitted]

SEQ ID NO: 8769 - protein, 108 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKR

SEQ ID NO: 8770 - protein, 108 aa, Artificial Sequence
  Description of Artificial Sequence: Synthetic polypeptide
EIVLTQSPDFQSVTPKEKVTITCRASQSIGTNIHWYQQKPDQSPKLLIKYASESISGVPSRFSGSGSGTDFTLTINSLEAEDAATYYCQQNNNWPTTFGAGTKLEIKR

SEQ ID NO: 8771 - protein, 113 aa, Artificial Sequence
  Description of Artificial Sequence: Synthetic polypeptide
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIK

SEQ ID NO: 8772 - protein, 135 aa, Artificial Sequence
  Description of Artificial Sequence: Synthetic polypeptide
MDTRAPTQLLGLLLLWLPGATFAQVLTQTPASVSAAVGGTVTISCQSSESVYKNNYLSWFQQKPGQPPKLLIYEASKLASGVSTRFKGSGSGTQFTLTISGVQCDDAATYYCLGEFSCYSGDCGTFGGGTAVVVK

SEQ ID NO: 8773 - protein, 133 aa, Artificial Sequence
  Description of Artificial Sequence: Synthetic polypeptide
MDTRVPTQLLGLLLLWLPGATFAQVLTQTPSPVSAAVGGTVTINCQASKSVYNNVQLSWFQQKPGQPPKRLIYYASTLASGVPSRFKGSGSGTQFTLTISDVQCDDVATYYCAGGYSSSSDNAFGGGTEVVVK

SEQ ID NO: 8774 - protein, 107 aa, Artificial Sequence
  Description of Artificial Sequence: Synthetic polypeptide
DIQMTQSPSSLLAALGERVSLTCRASQEISGYLSWLQQKPDGTIKRLIYAASTLDSGVPKRFSGSESGSDYSLTISSLESEDFADYYCLQYFSYPLTFGAGTKLELK

SEQ ID NO: 8775 - protein, 107 aa, Artificial Sequence
  Description of Artificial Sequence: Synthetic polypeptide
DILLTQSPAILSVSPGERVSFSCRTSQSIGTNIHWYQQRTNGFPRLLIKNVSESISGIPSRFSGSGSGTDFILSINSVESEDIADYYCQQSNTWPFTFGGGTKLEIK

SEQ ID NO: 8776 - protein, 121 aa, Artificial Sequence; identical to SEQ ID NO: 6400
  Description of Artificial Sequence: Synthetic polypeptide

SEQ ID NO: 8777 - protein, 107 aa, Artificial Sequence
  Description of Artificial Sequence: Synthetic polypeptide
EIVLTQSPDFQSVTPKEKVTITCRTSQSIGTNIHWYQQKPDQSPKLLIKNVSESISGVPSRFSGSGSGTDFTLTINSLEAEDAATYYCQQSNTWPFTFGGGTKVEIK

SEQ ID NO: 8778 - protein, 107 aa, Artificial Sequence
  Description of Artificial Sequence: Synthetic polypeptide
EIVLTQSPDFQSVTPKEKVTITCRTSQSIGTNIHWYQQKPDQSPKLLIKYVSESISGVPSRFSGSGSGTDFTLTINSLEAEDAATYYCQQSNTWPFTFGGGTKVEIK

SEQ ID NO: 8779 - protein, 107 aa, Artificial Sequence
  Description of Artificial Sequence: Synthetic polypeptide
EIVLTQSPDFQSVTPKEKVTITCRTSQSIGTNIHWYQQKPDQSPKLLIKYASESISGVPSRFSGSGSGTDFTLTINSLEAEDAATYYCQQSNTWPFTFGGGTKVEIK

SEQ ID NO: 8780 - protein, 107 aa, Artificial Sequence
  Description of Artificial Sequence: Synthetic polypeptide
EIVLTQSPDFQSVTPKEKVTFTCRTSQSIGTNIHWYQQKPDQSPKLLIKEVSESISGVPSRFSGSGSGTDFTLTINSLEAEDAATYYCQQSNTWPFTFGGGTKVEIK

SEQ ID NO: 8781 - protein, 107 aa, Artificial Sequence; identical to SEQ ID NO: 8774
  Description of Artificial Sequence: Synthetic polypeptide

SEQ ID NO: 8782 - protein, 107 aa, Artificial Sequence; identical to SEQ ID NO: 8775
  Description of Artificial Sequence: Synthetic polypeptide

SEQ ID NO: 8783 - protein, 107 aa, Artificial Sequence; identical to SEQ ID NO: 8777
  Description of Artificial Sequence: Synthetic polypeptide

SEQ ID NO: 8784 - protein, 107 aa, Artificial Sequence; identical to SEQ ID NO: 8778
  Description of Artificial Sequence: Synthetic polypeptide

SEQ ID NO: 8785 - protein, 107 aa, Artificial Sequence; identical to SEQ ID NO: 8779
  Description of Artificial Sequence: Synthetic polypeptide

SEQ ID NO: 8786 - protein, 107 aa, Artificial Sequence; identical to SEQ ID NO: 8780
  Description of Artificial Sequence: Synthetic polypeptide

SEQ ID NO: 8787 - protein, 107 aa, Artificial Sequence
  Description of Artificial Sequence: Synthetic polypeptide
DIQMTQSPSSLSASLGERVSLTCRASQEISGYLSWLQQKPDGTIRRLIYAASTLDSGVPKRFSGSWSGSDYSLTISSLESEDFADYYCLQYVSYPYTFGGGTKLEIK

SEQ ID NO: 8788 - protein, 112 aa, Artificial Sequence
  Description of Artificial Sequence: Synthetic polypeptide
QVQLVESGGGVVQPGRSLRLSCAASGFTFSDYYMAWVRQAPGKGLEWVASISYDGSNKYYGDSVKGRFTISRDNSKNTLYLQMNSLRAEDTAVYYCARPGDYWGQGTLVTVS

SEQ ID NO: 8789 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8790 - protein, 106 aa, Artificial Sequence
  Description of Artificial Sequence: Synthetic polypeptide
SYELMQPPSVSVSSGQTASIPCSGDKLEEKYVSWYQQRPGQSPVLVIYQDNKRPSGIPERFSGSNSGNTATLTISGTQAMDEADYYCQVWDNYSVLFGGGTKLTVL

SEQ ID NO: 8791 - protein, 106 aa, Artificial Sequence
  Description of Artificial Sequence: Synthetic polypeptide
SYELTQPLSESVAQGQTARITCGGNNIESRNVHWYQQKPGQAPVLVIYRDNNRPSGIPERFSGSNSGNMATLTISRAQAGDAADYYCQVWDNYTVLFGGGTKLTVL

SEQ ID NO: 8792 - protein, 106 aa, Artificial Sequence
  Description of Artificial Sequence: Synthetic polypeptide
SYELTQPPSVAVAPGKTARITCGGNNIGSKNVHWYQQKPGQAPVLVIYRDSNRPSGIPERFSGSNSGNTATLTISRAQAGDEADFYCQVWDNYIVLFGGGTKLTVL

SEQ ID NO: 8793 - protein, 106 aa, Artificial Sequence
  Description of Artificial Sequence: Synthetic polypeptide
QAVLTQPPSVSVAPGQTARIPCEGNNIGSKNVHWYRQKPGQVPVLVMYDDSDRPSGIPERFSGSNSGNTATLTISGTQAMDEADYYCQVWDNYSVLFGGGTKLTVL

SEQ ID NO: 8794 - protein, 106 aa, Artificial Sequence
  Description of Artificial Sequence: Synthetic polypeptide
QPVLTQPLSVSVAPGQTARITCGGNNIGSKNVHWYQQKPGQAPVLVIYRDSSRPSGIPERLSGSNSGDTATLTISRAQAGDEADYYCQVWDDYIVVFGGGTKLTVL

SEQ ID NO: 8795 - protein, 106 aa, Artificial Sequence
  Description of Artificial Sequence: Synthetic polypeptide
SYELTQPPSVSVTPGQTATITCGANDIGKRNVHWYQQRPGQSPVLVIYQDNKRPSGIPERFSGSNSGNTATLTISGTQAMDEADYYCQVWDNYSVLFGGGTKLTVL

SEQ ID NO: 8796 - protein, 106 aa, Artificial Sequence
  Description of Artificial Sequence: Synthetic polypeptide
QPVLTQPSSVSVAPGQTATISCGGHNIGSKNVHWYQQRPGQSPVLVIYQDNKRPSGIPERFSGSNSGNTATLTISGTQAMDEADYYCQVWDNYSVLFGGGTKLTVL

SEQ ID NO: 8797 - protein, 106 aa, Artificial Sequence
  Description of Artificial Sequence: Synthetic polypeptide
DIQMTQSPSTLSASVGDRVTITCRASQSISRWLAWYQQKPGKAPKLLIYKASSLESGVPSRFSGSGSGTEFTLTISSLQPDDFASYYCQQYNSYSTFGQGTKLEIK

SEQ ID NO: 8798 - protein, 107 aa, Artificial Sequence
  Description of Artificial Sequence: Synthetic polypeptide
AIRMTQSPSSVSASVGDRVTITCRASQGISSWLAWYQQKPGKAPKLLIYAASSLQSGVPSRFSGSGSGTDFTLTISSLQPEDFATYYCQQANSFPFTFGGGTKVEIK

SEQ ID NO: 8799 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTIRSLIPEDFATYYCQQTYNTPFTFGPGTKVEIK

SEQ ID NO: 8800 - protein, 108 aa, Artificial Sequence
  Description of Artificial Sequence: Synthetic polypeptide
AIQMTQSPSSLSASVGDRVTITCRASQNINNYLNWYHQKPGKAPNLLIYAASSLQSGVPSRFSGSGSGTDYTLTISSLQPEDFGNYYCQQSYSTSMYTFGQGTKLEIK

SEQ ID NO: 8801 - protein, 107 aa, Artificial Sequence
  Description of Artificial Sequence: Synthetic polypeptide
DIQLTQSPSSVSASVGDRVTITCRASQGISSWLAWYQQKPGKAPKLLIYAASSLQSGVPSRFSGSGSGTDFTLTISSLQPEDFATYYCQQTNSFPFPFGPGTKVDIK

SEQ ID NO: 8802 - protein, 107 aa, Artificial Sequence
  Description of Artificial Sequence: Synthetic polypeptide
DIQMTQSPSSVSASVGDRVTITCRASQGISSWLAWYQQKPGKAPKLLIYTASSLQSGVPSRFSGSGSRTDFTLTISSLQPEDFATYYCQQTNSLPLTFGPGTKVEIK

SEQ ID NO: 8803 - protein, 107 aa, Artificial Sequence
  Description of Artificial Sequence: Synthetic polypeptide
DIVMTQSPSSVSASVGDRVTITCRASQGISSWLAWYQQKPGKAPKLLIYAASSLRSGVPSRFSGSGSGTDFTLTITSLQPEDFATYYCQHTNSFPFTFGPGTKVEIK

SEQ ID NO: 8804 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYHCQQSYSIPITFGQGTRLEIK

SEQ ID NO: 8805 - protein, 106 aa, Artificial Sequence
  Description of Artificial Sequence: Synthetic polypeptide
DIQMTQSPSSLSASVGDRVTITCRASQDISNYLAWYQQKPGKVPKLLIYAASTLQSGVPFRFSGSGSGTDFTLTISSLQPEDVATYYCQKYNSAPPFGPGTKVDIK

SEQ ID NO: 8806 - protein, 108 aa, Artificial Sequence
  Description of Artificial Sequence: Synthetic polypeptide
DIQMTQSPSSLSASVGDRVTITCRASQSINNYLNWYHQKPGKAPKLLIYAASSLQSGVPSRFSGSGSGTDYTLTISSLQPEDFGNYYCQQSYRTSMYTFGQGTKVEIK

SEQ ID NO: 8807 - protein, 106 aa, Artificial Sequence
  Description of Artificial Sequence: Synthetic polypeptide
DIVMTQSPSSLSASVGDRVTITCRASQGISNYLAWYQQKPGKVPKLLIYSASTLQSGVPSRFSGSGSGTDFTLTISNLQPEDFATFFCQKYNSAPTFGGGTKVEIK

SEQ ID NO: 8808 - protein, 113 aa, Artificial Sequence
  Description of Artificial Sequence: Synthetic polypeptide
DIVMTQSPDSLAVSLGERATINCKSSQNILYSSDNKNYLAWYQKKPGQPPKLLIYWASTRESGVPDRFSGSGSGTDFTLTIISLQAEDVALYYCHQYYTTPPTFGQGTKVEIK

SEQ ID NO: 8809 - protein, 108 aa, Artificial Sequence
  Description of Artificial Sequence: Synthetic polypeptide
EIVMTQSPSSLSASVGDRVTITCRASQSINNYLNWYHQKPGKAPKLLIYAASSLQSGVPSRFSGSGSGTDYTLTISSLQPEDFGNYYCQQSYRTSMYTFGQGTKVEIK

SEQ ID NO: 8810 - protein, 107 aa, Artificial Sequence
  Description of Artificial Sequence: Synthetic polypeptide
DIQLTQSPSFLSASVGDRVTITCWASQGISSYLAWSQQKPGKAPKLLIYAASTLQSGVPSRFSGSGSGTEFTLTISSLQPEDFATYYCQQLNSYPWTFGQGTKVEIK

SEQ ID NO: 8811 - protein, 108 aa, Artificial Sequence
  Description of Artificial Sequence: Synthetic polypeptide
EIVLTQSPGTLSLSPGERATLSCRASQSVSSTYLAWLQQKPGQAPRLLIYGASSRATGIPDRFSGSGSGTDFTLTINRLEPEDFAVYYCQQYAYSPYTFGQGTKLEIK

SEQ ID NO: 8812 - protein, 108 aa, Artificial Sequence
  Description of Artificial Sequence: Synthetic polypeptide
DIQLTQSPSSLSASVGDRVTITCRASQSINNYLNWYHQKPGKAPKLLIYAASSLQSGVPSRFSGSGSGTDYTLTISSLQPEDFGNYYCQQSYRTSMYTFGQGTKVEIK

SEQ ID NO: 8813 - protein, 106 aa, Artificial Sequence
  Description of Artificial Sequence: Synthetic polypeptide
DIVMTQSPSTLSASVGDRVTITCRASQSISWWLAWYQQKPGKAPKLLIYKASSLESGVPSRFSGSGSGTEFTLTISSLQPDDFATYYCQQYNSYSTFGGGTKLEIK

SEQ ID NO: 8814 - protein, 107 aa, Artificial Sequence
  Description of Artificial Sequence: Synthetic polypeptide
DIQMTQSPSSVSASVGDRVTITCRASQGISSWLAWYQQKPGKAPKLLIYTTSSLQSGVPSRFSGSGSGTDFTLTISSLQPEDFATYYCQQANSFPLTFGGGTKVDIK

SEQ ID NO: 8815 - protein, 107 aa, Artificial Sequence
  Description of Artificial Sequence: Synthetic polypeptide
DIQMTQSPYSVSASVGDRVTITCRASQGISSWLAWYQQKPGRAPKLLIYAASSLQSGVPSRFSGSGSGTDFTLTISSLQPEDFATYYCQKTNSFPFTFGPGTKVEIK

SEQ ID NO: 8816 - protein, 107 aa, Artificial Sequence
  Description of Artificial Sequence: Synthetic polypeptide
DIQMTQSPSSLSASVGDRVTITCRASQDITNYLAWFQQKPGKAPKSLIYAASSLQSGVPSKFSGSGSGTDFTLTISSLQPEDFATYYCQQYNSYPPTFGPGTKVDIK

SEQ ID NO: 8817 - protein, 107 aa, Artificial Sequence
  Description of Artificial Sequence: Synthetic polypeptide
DIQMTQSPSSLSAFVGDRVTITCRASQDIRNYLDWFQQKPGKAPKSLIYAASNLQSGVPSRFGGSGSGTDFTLTINSLQPEDFVTYYCQQYNSYPPTFGGGTKVEIK

SEQ ID NO: 8818 - protein, 107 aa, Artificial Sequence; identical to SEQ ID NO: 8817
  Description of Artificial Sequence: Synthetic polypeptide

SEQ ID NO: 8819 - protein, 107 aa, Artificial Sequence; identical to SEQ ID NO: 8816
  Description of Artificial Sequence: Synthetic polypeptide

SEQ ID NO: 8820 - protein, 107 aa, Artificial Sequence
  Description of Artificial Sequence: Synthetic polypeptide
EIVLTQSPDTLSLSPGERATLSCRASQSVSSSYFAWYQQKPGQAPRLLMYSASSRATGIPDRFSGSGSGTDFSLTISRLEPEDFAVYYCQQYGRSLTFGGGTKVEIK

SEQ ID NO: 8821 - protein, 113 aa, Artificial Sequence
  Description of Artificial Sequence: Synthetic polypeptide
DIVMTQSPDSLAVSLGERATINCKSSQSVLYSSNNKNYLTWYQQKPGQPPKLLIYWASTRESGVPDRFSGSGSGTDFTLTISSLQAEDVAVYYCQQYYSTPPTFGLGTKVEIK

SEQ ID NO: 8822 - protein, 109 aa, Artificial Sequence
  Description of Artificial Sequence: Synthetic polypeptide
EIVMTQSPATLSVSPGERATLSCRASQSVDNNLVWYQQKPGQAPRLLIYGASTRATGIPARFSGSGSGTEFTLTISSLQSEDFAVYYCQQYNNWPPWTFGQGTKVEIKR

SEQ ID NO: 8823 - protein, 112 aa, Artificial Sequence
  Description of Artificial Sequence: Synthetic polypeptide
SYVLTQPPSVSGTPGQRVTISCSGGRSWIGSNTVKWYQQLPGTAPKLLIYGNDQRPSGVPDRFSGSKSGTSASLAITGVQAEDGADYYCQSYDRGTHPALLFGTGTKVTVLG

SEQ ID NO: 8824 - protein, 114 aa, Artificial Sequence
  Description of Artificial Sequence: Synthetic polypeptide
QSVLTQPPSVSGAPGQRVTISCSGSRSNIGSNTVKWYQQLPGTAPKLLIYYNDQRPSGVPDRFSGSKSGTSASLAITGLQAEDHPAEADYYCQSYDRYTHPALFGTGTKVTVLG

SEQ ID NO: 8825 - protein, 113 aa, Artificial Sequence
  Description of Artificial Sequence: Synthetic polypeptide
DVVLTQTPLSLPVNIGDQASISCKSTKSLLNSDGFTYLDWYLQKPGQSPQLLIYLVSNRFSGAPDRFSGSGSGTDFTLKISRVEAEDLGVYYCFQHNYLPLTFGAGTNLELKR

SEQ ID NO: 8826 - protein, 113 aa, Artificial Sequence
  Description of Artificial Sequence: Synthetic polypeptide
DVVLTQTPLSLPVNIGDQASISCRSTQTLLNSDGFTYLDWYLQKPGQSPQLLIYLVSNRFSGVPDRFSGSGSGTDFTLKISRVEAEDLGVYYCFQNNYLPLTFGAGTKLELKR

SEQ ID NO: 8827 - protein, 113 aa, Artificial Sequence
  Description of Artificial Sequence: Synthetic polypeptide
DVLMTQTPLSLPVSLGDQASISCRSSQNIVHSNGKTYLEWYLQRPGQSPKLLIYKVSNRFSGVPDRFSGSGSGTDFTLKISRVEAEDLGVYYCFQGSHVPYTFGGGTKLEIKR

SEQ ID NO: 8828 - protein, 113 aa, Artificial Sequence
  Description of Artificial Sequence: Synthetic polypeptide
DVVMTQTPLSLPVSLGDQASISCRSSQSLVHSHGNTYLHWYLQKPGQSPKLLIYTVSNRFSGVPDRFSGSGSGTDFTLKISRVEAEDLGVYFCSQSTHVPYTFGGGTKLEIKR

SEQ ID NO: 8829 - protein, 113 aa, Artificial Sequence
  Description of Artificial Sequence: Synthetic polypeptide
DVVLTQTPLTLSVTIGQPASISCKSSQSLLDSDGETYLNWLLQRPGQSPKRLIYLVSKLDSGVPDRFTGSGSGTDFTLKISRVEAEDLGVYYCWQGTHFPWTFGGGTKLEIKR

SEQ ID NO: 8830 - protein, 114 aa, Artificial Sequence
  Description of Artificial Sequence: Synthetic polypeptide
DIVMSQSPSSLAVSVGEKVTMSCKSSQNLLYSSNQKNYLAWYQQKPGQSPKLLIYWASTRESGVPDRFTGSGSGTDFTLTISSVKAEDLAVYYCQQYYSYPFTFGSGTKLEIKR

SEQ ID NO: 8831 - protein, 108 aa, Artificial Sequence
  Description of Artificial Sequence: Synthetic polypeptide
DIQMTQTASSLSASLGDRVTISCRASQDIRNYLNWYQRKPDGTVKLLIFYTSKLHSGVPSRFSGSGSGTDYSLTIRNLEQEDIATYFCQQGNTLPLTFGGGTKLEIKR

SEQ ID NO: 8832 - protein, 108 aa, Artificial Sequence
  Description of Artificial Sequence: Synthetic polypeptide
DIQMTQTASSLSASLGDRVTISCRASQDIRNYLNWYQRKPDGTVKLLIYYTSRLHSGVPSRFSGSGSGTDYSLTISNLEQEDIATYFCQQGNTLPLTFGGGTKLEIKR

SEQ ID NO: 8833 - protein, 108 aa, Artificial Sequence
  Description of Artificial Sequence: Synthetic polypeptide
DIQMTQTTSSLSASLGDRVTITCRASQDIRNYLNWYQQKPDGTVKLLIYYTSRLHSGVPSRFSGSGSGTDYSLTISNLDQEDIATYFCQQGNTLPLTFGGGTRLEIKR

SEQ ID NO: 8834 - protein, 118 aa, Artificial Sequence
  Description of Artificial Sequence: Synthetic polypeptide
QVQLKESGPGLVAPSQSLSITCTVSGFSLTGYGVNWVRQPPGKGLEWLGMIWGDERIDYNSALKSRLSITKDNSKSQVFLKMNSLQTDDTGRYFCARDGYFPYAMDYWGQGTSVTVSS

SEQ ID NO: 8835 - protein, 118 aa, Artificial Sequence
  Description of Artificial Sequence: Synthetic polypeptide
QVQLKESGPGLVAPSQSLSITCTVSGFSLTGSSINWVRQPPGKGLEWLGMIWGDGRIDYNSVLKSRLSISKDSSKSQVFLKMNSLQADDTARYYCARDGYYPYAMVYWGQGTSVTVSS

SEQ ID NO: 8836 - protein, 118 aa, Artificial Sequence
  Description of Artificial Sequence: Synthetic polypeptide
QVQLKESGPGLVAPSQSLSITCTVSEFSLTGSSVNWVRQPPGKGLEWLGMIWGDGRIDYNSALKSRLSISKDNSKSQVFLKMNSLQTDDTARYYCARDGYYPYAMNYWGQGTSVTVSS

SEQ ID NO: 8837 - protein, 118 aa, Artificial Sequence
  Description of Artificial Sequence: Synthetic polypeptide
QVQLKESGPGLVAPSQSLSITCTVSGFSLTGYNINWVRQPPGKGLEWLGLIWGDGNTAFNSALKSRLSISKDNSKSQVFLKLNSLQTDDTARYYCARDGYYPYAIKYWGQGTSVTVSS

SEQ ID NO: 8838 - protein, 118 aa, Artificial Sequence
  Description of Artificial Sequence: Synthetic polypeptide
QVQLKESGPGLVAPSQSLSITCTVSGFSLTGHNINWVRQPPGKGLEWLGMIWGDGNTDFNSALKSRLSISKDNSKSQVFLKLNSLQTDDTARYYCARDGYYPYAIKFWGQGTSVTVSS

SEQ ID NO: 8839 - protein, 108 aa, Artificial Sequence
  Description of Artificial Sequence: Synthetic polypeptide
DIQMTQSPASLSVSVGETVTITCRASENIYSNLAWYRQKQGKSPQLLVFAASNLADGVPSRFSGSGSGTQYSLKINSLQSEDFGDYYCQHFWTTPWAFGGGTNLEIKR

SEQ ID NO: 8840 - protein, 108 aa, Artificial Sequence
  Description of Artificial Sequence: Synthetic polypeptide
DIQLTQSPSSLSASVGDRVTITCRASENIYSNLAWYRQKPGKAPKLLVFAASNLADGVPSRFSGSGSGTDYTFTISSLQPEDIATYYCQHFWTTPWAFGGGTKLQIKR

SEQ ID NO: 8841 - protein, 108 aa, Artificial Sequence; identical to SEQ ID NO: 8840
  Description of Artificial Sequence: Synthetic polypeptide

SEQ ID NO: 8842 - protein, 110 aa, Artificial Sequence
  Description of Artificial Sequence: Synthetic polypeptide
AIQLTQSPDSLAVSLGERATIKCKSSQSVLYSSNNKNYLAWYQQKPGQPPNLLIYWASTRESGVPDRFSGSGSGTDFTLTISSLQAEDVAVYYCQQYFSFGQGTKVDIKR

SEQ ID NO: 8843 - protein, 108 aa, Artificial Sequence
  Description of Artificial Sequence: Synthetic polypeptide
DIQMTQSPSSVSASVGDRVTITCRSSQDINNWLVWYQQKPGKAPKVLIYGASRLQSGVPSRFSGSGSGTDFTLTISSLQPEDFATYYCQQANSFPLTFGGGTKVEIKR

SEQ ID NO: 8844 - protein, 108 aa, Artificial Sequence
  Description of Artificial Sequence: Synthetic polypeptide
DIQMTQSPSSVSASVGDRVTITCRSSQDINNWLVWYQQKPGKAPKVLIYGASRLQSGVPSRFSGSGSGTDFTLTISSLQPEDFATYYCQQANSFPLTFGGGTKLEIKR

SEQ ID NO: 8845 - protein, 108 aa, Artificial Sequence
  Description of Artificial Sequence: Synthetic polypeptide
AIQLTQSPSSLSASVGDRVTITCRASQDINNWLVWYQQKPGKAPKLLIYAASSLQSGVPSRFSGSGSGTDFTLTISSLQPEDFATYYCQQANSFPLTFGGGTKVDIKR

SEQ ID NO: 8846 - protein, 108 aa, Artificial Sequence
  Description of Artificial Sequence: Synthetic polypeptide
DIQMTQSPSSLSASVGNRVTITCRASQGIRNDLGWYQQKPGKAPKRLIYAASSLQSGVPSRFSGSGSGTEFTLTISSLQPEDFATYYCLQHNSYPLTFGRGTKVEIKR

SEQ ID NO: 8847 - protein, 112 aa, Artificial Sequence
  Description of Artificial Sequence: Synthetic polypeptide
DIVMTQTPLSSPVTLGQPASISCRSSQSLVKSDGNTYLSWLQQRPGQPPRLLIYKISNRFSGVPDRFSGSGAGTDFTLKISRVEAEDVGVYYCMQTTQFPFTFGPGTKVDIK

SEQ ID NO: 8848 - protein, 108 aa, Artificial Sequence
  Description of Artificial Sequence: Synthetic polypeptide
DIQLTQSPSSVSASVGNRVTITCRASQDINNWLVWYHQNPGKAPKVLIYGASRLQSGVPSRFSGSGSGTDFTLTISSLQPEDFATYYCQQANSFPLTFGGGTKVEIKR

SEQ ID NO: 8849 - protein, 108 aa, Artificial Sequence
  Description of Artificial Sequence: Synthetic polypeptide
DIQLTQSPSSLSASVGNRVTITCRASQGIRNDLAWFQQKPGKAPKPLIYAASSLQSGVPSRFSGSGSGTEFTLTISSLQPEDFATYYCLQHNSYPWTFGQGTKVEIKR

SEQ ID NO: 8850 - protein, 108 aa, Artificial Sequence
  Description of Artificial Sequence: Synthetic polypeptide
DIQLTQSPSFLSASVGNRVTITCWASQGISSYLAWYQQKPGKAPKLLIYAASTLQSGVPSRFSGSGSGTEFTLTISSLQPEDFATYYCQQLNSYPFTFGPGTKVEIKR

SEQ ID NO: 8851 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLKSGVPSRFSGSGSGTEFILTISSLQPDDFATYYCQQYNSYWTFGQGTKVEIKR

SEQ ID NO: 8852 - protein, 108 aa, Artificial Sequence
  Description of Artificial Sequence: Synthetic polypeptide
AIQMTQSPSSLSASVGNRVTITCRASQGIINDLGWYNQKPWKAPKRLIYAASILQSGVPSRFSGRGCGTEFSLTISSLQPEDFATYYCLQHNSYPLTFGGGTKVEIKR

SEQ ID NO: 8853 - protein, 108 aa, Artificial Sequence
  Description of Artificial Sequence: Synthetic polypeptide
DIQLTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIKR

SEQ ID NO: 8854 - protein, 108 aa, Artificial Sequence
  Description of Artificial Sequence: Synthetic polypeptide
DIPMTQSPSSLSASVGDRVTITCRASQGIRNDLGWYQQKPGKAPKRLIYAASSLQSGVPSRFTGSGSGTEFTLTISSLQPEDFATYYCLQHNSYPFTFGQGTKMEIKR

SEQ ID NO: 8855 - protein, 108 aa, Artificial Sequence
  Description of Artificial Sequence: Synthetic polypeptide
DIPMTQSPSSLSASVGNRVTITCRASQGISNYLAWYHHKPGKVPKLLIYAASTLQSGVPSRFSGSGSGTDFTLTIHSLQPEDVATYYCQKYNSAPFTFGPGTKVEIKR

SEQ ID NO: 8856 - protein, 108 aa, Artificial Sequence
  Description of Artificial Sequence: Synthetic polypeptide
DIQMTQSPSSVSASVGNRVTITCRASQGISSWLAWYQQKPGKAPKLLIYAASSLQSGVPSRFSGSGSGTDFTLTISSLQPEDFATYYCQQANSFPPTFGQGTKVEIKR

SEQ ID NO: 8857 - protein, 108 aa, Artificial Sequence
  Description of Artificial Sequence: Synthetic polypeptide
AIQMTQSPSSLSASVGNRVTITCRASQGINNWLGWYQQKPGKAPKVLIYAASSLQSGVPSRFSGSGSGTDFTLTISSLQPEDFATYYCQQDNSFPLTFGRGTKVEIKR

SEQ ID NO: 8858 - protein, 112 aa, Artificial Sequence
  Description of Artificial Sequence: Synthetic polypeptide
DIVMTQTPLSSPVTLGQPASISCRSSQSLVKSDGNTYLSWLQQRPGQPPRLLIYKISNRFSGVPDRFSGSGAGTDFTLKISRVEAEDVGIYYCMQTTQFPFTFGPGTKVDIK

SEQ ID NO: 8859 - protein, 108 aa, Artificial Sequence
  Description of Artificial Sequence: Synthetic polypeptide
DIQMTQSPSSLSASVGNRVTITCRASQGIRNDLGWYHQKPGKAPKRLIYAASTLQSGVPSRFSGSGSGTEFTLTISSLQPEDFATYYCLQHNSYPFTFGQGTKVEIKR

SEQ ID NO: 8860 - protein, 108 aa, Artificial Sequence
  Description of Artificial Sequence: Synthetic polypeptide
DIQMTQSPSSLSASVGDRVTITCRASQDITNYLAWYQQKPGKVPKLLIYTTSTLQSGVPSRFSGSGSGTDFTLTITSLQPEDVATYFCQKYNSDPFTFGPGTKVEIKR

SEQ ID NO: 8861 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPWTFGQGTKVEIKR

SEQ ID NO: 8862 - protein, 108 aa, Artificial Sequence
  Description of Artificial Sequence: Synthetic polypeptide
DIQLTQSPSSLSASVGNRVTITCRASQGISNYLAWYQQKPGKAPKLLIYAASTLQSGVPSRFSGSGSGTDFTLTISSLQPEDVATYYCQKYNSAPLTFGGGTKVEIKR

SEQ ID NO: 8863 - protein, 113 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPQTFGQGTKVEIKR

SEQ ID NO: 8864 - protein, 108 aa, Artificial Sequence
  Description of Artificial Sequence: Synthetic polypeptide
DIQLTQSPSSVSASVGNRVTITCRASQGISSWLAWYQQKPGKAPNLLIYAISSLRSGVPSRFSGSGSGTDFTLTISSLQPEDFATYYCQQAKSFPYTFGQGTKVEIKR

SEQ ID NO: 8865 - protein, 108 aa, Artificial Sequence
  Description of Artificial Sequence: Synthetic polypeptide
DIQMTQSPSSFSASTGNRVTITCRASQGISSYLAWYHQKPRKAPKLLIYAASTLQSGVPSRFSGSGSGTDFTLTISSLQSEDFATYYCQQYYSYPWTFGQGTKVEIKR

SEQ ID NO: 8866 - protein, 108 aa, Artificial Sequence
  Description of Artificial Sequence: Synthetic polypeptide
DIQLTQSPSFLSASVGNRVTITCWASQDISSYLVWYQQKPGKAPKLLIYAASTLQSGVPSRFSGSGSGTEFTLTISSLQPEDFATYYCQQLNTCPFTFGPGTKVEIKR

SEQ ID NO: 8867 - protein, 109 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFTGSGSGTEFTLTISSLQPDDFATYYCQQYNSYSPWTFGQGTKVEIKR

SEQ ID NO: 8868 - protein, 108 aa, Artificial Sequence
  Description of Artificial Sequence: Synthetic polypeptide
DIPMTQSPSSFSASTGNRVTITCRASQGIRSYLAWYHQKPGKAPKLLIYAASTLQSGVPSRFTGSGSGTDFTLTISCLQSEDFATYYCQQYYSYPFTFGQGTKVEIKR

SEQ ID NO: 8869 - protein, 107 aa, Artificial Sequence
  Description of Artificial Sequence: Synthetic polypeptide
AIQMTQSPSSLSAYVGDRVTITCRASQDIRNDLGWYQQKPGKAPNLLIYDISSLQSGVPSRFSGSGSGTDFTLTISSLQPEDFATYYCLQDYNYPLTFGGGTKVEIK

SEQ ID NO: 8870 - protein, 108 aa, Artificial Sequence
  Description of Artificial Sequence: Synthetic polypeptide
DIPMTQSPSFLSASVGSRVTITCWASQGISSYLVWYQQKPGKAPKLLMYEASNPQSGVPSRFTGSGLGTEFIVPISSLQPEDFSSYYCQQINKYPLTFGGGTKMEIKR

SEQ ID NO: 8871 - protein, 108 aa, Artificial Sequence
  Description of Artificial Sequence: Synthetic polypeptide
AIQMTQSPSSLSASVGNRVTITCRASQGIRNDLGWYQQKPGKAPKLLIYAASSLQSGVPSRFSGSGSGTDFTLTISSLQPEDFATYYCLQDYNYPHTFGQGTKVEIKR

SEQ ID NO: 8872 - protein, 108 aa, Artificial Sequence
  Description of Artificial Sequence: Synthetic polypeptide
DIQMTQSPSFLSASVGNRVTITCWASQGIRNYLAWYHQKPGKAPKLLIYAASTLQSGVPSRFSGSGSGTDFTLTISSLQPEDFATYYCQQLNSYPLTFGGGTKVEIKR

SEQ ID NO: 8873 - protein, 113 aa, Artificial Sequence
  Description of Artificial Sequence: Synthetic polypeptide
DVVMTQTPLSSPVTLGQPASISCRSSQGLVRSDGNTYLSWLQQRPGQPPRLLIYKISNRFSGVPDRFSGSGAGTTFTLKINRVEVEDVGVYYCLQATQFPFTFGHGTKVEIKR

SEQ ID NO: 8874 - protein, 108 aa, Artificial Sequence
  Description of Artificial Sequence: Synthetic polypeptide
DIQLTQSPSSLSASVGNRVTITCRASQGISNYLAWFQQKPGKAPKSLIYAASSLQSGVPSKFSGSGSGTDFTLTISSLQPEDFATYYCQQYNSYPLTFGGGTKLEIKR

SEQ ID NO: 8875 - protein, 108 aa, Artificial Sequence
  Description of Artificial Sequence: Synthetic polypeptide
DIQMTQSPSSLSASTGNRVTITCRASQGISSCLAWYHQKPGKAPKLLIYAASTLQSGVPSRFSGSGSGTDFTLTISCLQSEDFATYYCQQYYSYPLTFGGGTKVEIKR

SEQ ID NO: 8876 - protein, 113 aa, Artificial Sequence
  Description of Artificial Sequence: Synthetic polypeptide
DIVMTQTPLSSPVSLGHPASISCRSSQSLKKSDGNTYLSWLQQRPGQPPRLLIYNISNRFSGVPDRFSGSGAGTDFTLKITRVEAEDVGFYYCMQTTQFPFTFGPGTKVEIKR

SEQ ID NO: 8877 - protein, 108 aa, Artificial Sequence
  Description of Artificial Sequence: Synthetic polypeptide
AHPMTQSPSFLSASVGNRVTITCWASQGISSYLAWYQQKPGKAPKLLIYAASTLQSGVPSRFTGSGSGTEFTLTISSLQPEDFATYYCQQLNSYPRTFGQGTKLDIKR

SEQ ID NO: 8878 - protein, 108 aa, Artificial Sequence
  Description of Artificial Sequence: Synthetic polypeptide
DIQMTQSPSFLSASVGDRVTITCWASQGISSYLAWYQQKPGKAPKLLIYATSTLQSGVPSRFSGSGSGTEFTLTISSLQPEDFATYYCQQLNSYPLTFGGGTKVEIKR

SEQ ID NO: 8879 - protein, 112 aa, Artificial Sequence; identical to SEQ ID NO: 8847
  Description of Artificial Sequence: Synthetic polypeptide

SEQ ID NO: 8880 - protein, 114 aa, Artificial Sequence
  Description of Artificial Sequence: Synthetic polypeptide
DIQLTQSPDSLAVSLGERATINCKSSQSVLYSSNNKNYLTWYQQKPGQPPNLLIYWTSTRESGVPDRFSGSGSGTDFTLTISSLQAEDVAVYYCQQYYSIPYTFGQGTKVEIKR

SEQ ID NO: 8881 - protein, 114 aa, Artificial Sequence
  Description of Artificial Sequence: Synthetic polypeptide
AIQMTQSPDSLAVSLGERATINCKSSQSVLYSSDNENCLTWYQQKPGQPPKLLIYWASTRESGVPDRFSGSGSGTDFTLTISSLQAEDVAVYYCQQHYNIPYTFGQGTKVEIKR

SEQ ID NO: 8882 - protein, 114 aa, Artificial Sequence
  Description of Artificial Sequence: Synthetic polypeptide
DIQMTQSPDSLAVSLGERATINCKSSQSVLYSSNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 8883 - protein, 114 aa, Artificial Sequence
  Description of Artificial Sequence: Synthetic polypeptide
AIRMTQSPDSLAVSLGERATINCKSSQSVLYSSDNKNYLVWYQQKPGQPPNLLIYWASTRESGVPDRFSGSGSGTDFTLTISSLQAEDVAVYYCQQHYNPPYSFGQGTKVEIKR

SEQ ID NO: 8884 - protein, 114 aa, Artificial Sequence
  Description of Artificial Sequence: Synthetic polypeptide
DIQMTQSPDSLTVSLGERATINCKSSQSVLYSSNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 8885 - protein, 108 aa, Artificial Sequence
  Description of Artificial Sequence: Synthetic polypeptide
DIQMTQSPDFQSVTPKEKVTITCRASQSIGSSLHWYQQKPDQSPKLLIKYASQSFSGVPSRFSGSGSGTDFTLMINSLEAEDAATYYCHQSGGLPWTFGQGTKVEIKR

SEQ ID NO: 8886 - protein, 114 aa, Artificial Sequence
  Description of Artificial Sequence: Synthetic polypeptide
DIQMTQSPDSLAVSLGERATINCKSSQTVLHSSNNQNNLVWYQQKPGQPPKLLIYWASTRESGVPDRFSGSGSGTDFTLTISSLQAEDVAIYYCQQYYSTPYTFGQGTKLEIKR

SEQ ID NO: 8887 - protein, 108 aa, Artificial Sequence
  Description of Artificial Sequence: Synthetic polypeptide
DIQMTQSPSSLSASVGDRVTITCRASQGISNYLAWFQQKPGKAPKSLIYGASSLQSGVPSKFSGSGSGTDFTLTISSLQPEDFATYYCQQYNSYPLTFGGGTKVEIKR

SEQ ID NO: 8888 - protein, 114 aa, Artificial Sequence
  Description of Artificial Sequence: Synthetic polypeptide
DIQMTQSPDSLAVSLGERATINCKSSQSVLFISNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 8889 - protein, 108 aa, Artificial Sequence; identical to SEQ ID NO: 8887
  Description of Artificial Sequence: Synthetic polypeptide

SEQ ID NO: 8890 - protein, 113 aa, Artificial Sequence
  Description of Artificial Sequence: Synthetic polypeptide
DIVMTQSPLSLPVTPGEPASISCRSSQSLLHSNGYNYLDWYLQKTGQSPQLLIYLGSNRASGVPDRFSGSGSGTDFTLKISRVEAEDVGIYYCMQALQALPFTFGPGTKVDIK

SEQ ID NO: 8891 - protein, 114 aa, Artificial Sequence
  Description of Artificial Sequence: Synthetic polypeptide
DIQMTQSPNSLEVSLGERATINCKSSQSVLSTSNNKNYLTWYQQKPGQPPNLLIYWASTRESGVPDRFTGSGSGTDFTLTISSLQAEDVAVYYCQQYYNIPYTFGQGTKVEIKR

SEQ ID NO: 8892 - protein, 108 aa, Artificial Sequence
  Description of Artificial Sequence: Synthetic polypeptide
DIQMTQSPSSVSASVGDRVIITCRASQGIRTWLAWYQQKPGKAPKLLIYAASSLQSGVPSRFSGSGSGTEFTLTISSLQPEDFVTYYCQQVNSFPLTFGGGTKVEIKR

SEQ ID NO: 8893 - protein, 108 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVEIKR

SEQ ID NO: 8894 - protein, 114 aa, Artificial Sequence
  Description of Artificial Sequence: Synthetic polypeptide
AIQMTQSPDSLAVSLGERATINCKSSQSVLYSSDNKNYLVWYQQKPGQPPNLLIYWASTRESGVPDRFSGSGSGTDFTLTISSLQAEDVAVYYCQQHYNPPYSFGQGTKVEIKR

SEQ ID NO: 8895 - protein, 114 aa, Artificial Sequence
  Description of Artificial Sequence: Synthetic polypeptide
DIQMTQSPDSLAVSLGERATINCKSSQSVLYSSNNKNYLVWYQQKPGQPPNLLIYWASTRESGVPDRFSGSGSGTDFTLTISSLQAEDVAVYYCQQYYNPPYTFGQGTKVEIKR

SEQ ID NO: 8896 - protein, 114 aa, Artificial Sequence
  Description of Artificial Sequence: Synthetic polypeptide
DIQMTQSPDSLAVSLGERATINCKSSQTVLHSSNNQNNLVWYQQKPGQPPKLLIYWASTRESGVPDRFSGSGSGTDFTLTISSLQAEDVAIYYCQQYYSTPYTFGQGTKVEIKR

SEQ ID NO: 8897 - protein, 114 aa, Artificial Sequence
  Description of Artificial Sequence: Synthetic polypeptide
AIRMTQSPDSLAVSLGERATINCKSSQSVLYSSNNKNYLTWYQQKPGQPPKLLIYWTSTRESGVPDRFSGSGSGTDFTLTISSLQAEDVAVYYCQQYYSTPYTFGQGTKVEIKR

SEQ ID NO: 8898 - protein, 114 aa, Artificial Sequence
  Description of Artificial Sequence: Synthetic polypeptide
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSSPYTFGQGTKVEIKR

SEQ ID NO: 8899 - protein, 114 aa, Artificial Sequence
  Description of Artificial Sequence: Synthetic polypeptide
DIQMTQSPDSLAVSLGERATINCKSSQSVLYSSNNQNYLAWYQQKPGQPPKLLIYWASTRESGVPDRFSGSGSGTDFTLTISSLQAEDVAVYYCQQYYSTPYTFGQGTKVEIKR

SEQ ID NO: 8900 - protein, 108 aa, Artificial Sequence
  Description of Artificial Sequence: Synthetic polypeptide
DIQMTQSPSSLSASVGDRGTITCRTSQSIRSYLNWYQQKPGKAPKLLIYAASSLQSGVPSRFSGSGSGTDFTLTISSLQPEDFATYFCQQSYSSPFTFGQGTKVEIKR

SEQ ID NO: 8901 - protein, 114 aa, Artificial Sequence
  Description of Artificial Sequence: Synthetic polypeptide
DIQMTQSPDSLAVSLGERATINCKSSQSVLYSSNNKNYLGWYQQKAGQPPKLLIYWASTRESGVPDRFSGSGSGTDFTLTISSLQAEDVAVYYCQQYYGIPWTFGQGTKVEIKR

SEQ ID NO: 8902 - protein, 114 aa, Artificial Sequence
  Description of Artificial Sequence: Synthetic polypeptide
DIQMTQSPESLAVSLGERATINCKSSQSVLDSSNNRNYLAWYQQKPGQPPKLFIYWASTRESGVPDRFSGSGSGTDFTLTISSLQAEDVAVYYCQQYYSTPLTFGGGTKLEIKR

SEQ ID NO: 8903 - protein, 108 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIKR

SEQ ID NO: 8904 - protein, 108 aa, Artificial Sequence
  Description of Artificial Sequence: Synthetic polypeptide
DIQMTQSPSFLSASVGDRVTITCWASQGISSYLAWYQQKPGKAPKLLIYAASTLQSGVPSRFSGSGSGTEFTLTISSLQPEDFATYYCQQFNSYPPTFGQGTKVEIKR

SEQ ID NO: 8905 - protein, 114 aa, Artificial Sequence
  Description of Artificial Sequence: Synthetic polypeptide
DIRMTQSPDSLAVSLGERATINCKSSQSVLSSSNNKNYLAWYQQKPGQPPKLLIYWASTRESGVPDRFSGSGSGTDFSLTISSLQAEDLAVYYCQQYYSTPLTFGGGTKVEIKR

SEQ ID NO: 8906 - protein, 108 aa, Artificial Sequence
  Description of Artificial Sequence: Synthetic polypeptide
DIQMTQSPSSLSASVGDRVTITCRASQGINNYLAWFQQKPGKAPKSLIYAASSLQSGVPSKFSGSGSGTDFTLTISSLQPEDVAIYYCQQYNSYPLTFGGGTKVEIKR

SEQ ID NO: 8907 - protein, 114 aa, Artificial Sequence
  Description of Artificial Sequence: Synthetic polypeptide
DIQLTQSPDSLAVSLGERATINCKSSQSVLYSSNNKNYLAWYQQKPGQPPKLLFYWASTRESGVPDRFSGSGSGTDFTLTISSLQAEDVAVYYCHQSYNIPYTFGQGTKVEIKR

SEQ ID NO: 8908 - protein, 113 aa, Artificial Sequence
  Description of Artificial Sequence: Synthetic polypeptide
DIQMTQSPLSLPVTPGEPASISCRSSQSLLHSNGYNFLDWYLQKPGQSPQLLIYLGSNRASGVPDRFSGSGSGTDFTLKFSRVEAEDVGVYYCMQTLQTPWTFGQGTKVEIKR

SEQ ID NO: 8909 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLHSGVPSKFSGSGSGTDFTLTISSLQPEDFATYYCQQYNSYPLTFGGGTKVEIKR

SEQ ID NO: 8910 - protein, 108 aa, Artificial Sequence
  Description of Artificial Sequence: Synthetic polypeptide
DIQMTQSPSFLSASVGDRVTITCWASQGSGSYLAWYQQKPGKAPKLLIYAASTLQSGVPSRFSGSGSGTEFTLTISSLQPEDFATYYCQQLNNYLFIFGPGTKVEIKR

SEQ ID NO: 8911 - protein, 108 aa, Artificial Sequence
  Description of Artificial Sequence: Synthetic polypeptide
DIQMTQSPSSLSASVGDRVTITCRASQGINNFLAWFQQKPGKAPKSLIYAASRLQSGVPSKFSGSGSGTDFTLTISSLQPEDFATYYCLQYNSYFRTFGQGTKVEIKR

SEQ ID NO: 8912 - protein, 108 aa, Artificial Sequence; identical to SEQ ID NO: 8887
  Description of Artificial Sequence: Synthetic polypeptide

SEQ ID NO: 8913 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLHSGVPSKFSGSGSGTDFTLTISSLQPEDFATYYCLQYNSYPLTFGGGTKVEIKR

SEQ ID NO: 8914 - protein, 108 aa, Artificial Sequence; identical to SEQ ID NO: 8909
  Description of Artificial Sequence: Synthetic polypeptide

SEQ ID NO: 8915 - protein, 108 aa, Artificial Sequence
  Description of Artificial Sequence: Synthetic polypeptide
DIQMTQSPSSLSASVGDRVTITCRASQDISNYLAWFQQKPGKAPKSLIYAASSLQSGVPSKFSGSGSGTDFTLTISSLQPEDFATYYCHQYNSYPLTFGGGTKVEIKR

SEQ ID NO: 8916 - protein, 113 aa, Artificial Sequence; identical to SEQ ID NO: 8908
  Description of Artificial Sequence: Synthetic polypeptide

SEQ ID NO: 8917 - protein, 113 aa, Artificial Sequence
  Description of Artificial Sequence: Synthetic polypeptide
DIQLTQSPLSLPVTPGEPASISCRSSQSLLHSNGYNFLDWYLQKPGQSPQLLIYLGSNRASGVPDRFSGSGSGTDFTLKFSRVEAEDVGLYYCMQTLQTPWTFGQGTKVEIKR

SEQ ID NO: 8918 - protein, 114 aa, Artificial Sequence
  Description of Artificial Sequence: Synthetic polypeptide
DIQMTQSPDSLAVSLGERATINCKSSQSVLYSSNNKNYLAWYQQKPGQPPKLLFYWASARESGVPDRFSGSGSGTDFTLTISSLQAEDVAVYYCHQSYNIPYTFGQGTKVEIKR

SEQ ID NO: 8919 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLHSGVPSKFSGSGSGTDFTLTISSLQPEDFATYYCQQYNSYPLTFGGGTKLEIKR

SEQ ID NO: 8920 - protein, 108 aa, Artificial Sequence; identical to SEQ ID NO: 8915
  Description of Artificial Sequence: Synthetic polypeptide

SEQ ID NO: 8921 - protein, 108 aa, Artificial Sequence; identical to SEQ ID NO: 8913
  Description of Artificial Sequence: Synthetic polypeptide

SEQ ID NO: 8922 - protein, 108 aa, Artificial Sequence
  Description of Artificial Sequence: Synthetic polypeptide
DIQMTQSPSSVSASVGDRVTITCRASQGISNYLAWFQQKPGKAPKSLIYAASSLHSGVPSKFSGSGSGTDFTLTISSLQPEDFATYYCQQYNSYPLTFGGGTKVEIKR

SEQ ID NO: 8923 - protein, 107 aa, Artificial Sequence
  Description of Artificial Sequence: Synthetic polypeptide
DIQLTQSPSFLSTSVGDRVTITCWASQGISSYLAWYQQKPGKAPNLLIYTASTLQSGVPSRFSGSGSGTEFTLTISSLQPEDFATYYCQQLNSYPYTFGQGTKLEIK

SEQ ID NO: 8924 - protein, 114 aa, Artificial Sequence; identical to SEQ ID NO: 8882
  Description of Artificial Sequence: Synthetic polypeptide

SEQ ID NO: 8925 - protein, 113 aa, Artificial Sequence; identical to SEQ ID NO: 8908
  Description of Artificial Sequence: Synthetic polypeptide

SEQ ID NO: 8926 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIKR

SEQ ID NO: 8927 - protein, 108 aa, Artificial Sequence
  Description of Artificial Sequence: Synthetic polypeptide
DIQMTQSPSSLSASVGDRVTITCRASQGIRNDLDWYQQKPGKAPKRLIYTASSLQSGVPSRFSGSGSGTEFTLTISSLQPEDFATYYCLQYSNYPPTFGQGTKVEIKR

SEQ ID NO: 8928 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLHSGVPSKFSGSGSGTDFTLTISSLQPEDFATYYCQQYDSYPLTFGGGTKVEIKR

SEQ ID NO: 8929 - protein, 108 aa, Artificial Sequence
  Description of Artificial Sequence: Synthetic polypeptide
DIQMTQSPSSLSASVGDRVTITCRASQGINNYLAWFQQKPGKAPKSLIYAASSLQSGVPSKFSGSGSGTDFTLTISSLQPEDFAIYYCQQYNSYPLTFGGGTKVEIKR

SEQ ID NO: 8930 - protein, 108 aa, Artificial Sequence
  Description of Artificial Sequence: Synthetic polypeptide
DIQMTQSPSSLSASVGDRVTITCRASQGINNFLAWFQQKPGKAPKSLIYAASSLQSGVPSKFSGSGSGTDFTLTISSLQPEDFATYYCLQYSSYFRTFGQGTKVEIKR

SEQ ID NO: 8931 - protein, 114 aa, Artificial Sequence
  Description of Artificial Sequence: Synthetic polypeptide
AIQMTQSPDSLAVSLGERATINCRSSQSVLYSSTNKNYLAWYQQKPGQPPKLLIYWASTRDSGVPDRFSGSGSGTDFTLTISSLQAEDVAVYYCQQYYSIYRTFGQGTKVEIKR

SEQ ID NO: 8932 - protein, 114 aa, Artificial Sequence
  Description of Artificial Sequence: Synthetic polypeptide
DIQMTQSPDSLAVSLGERATINCKSSQSVLSSSNNENYLVWYQQKPGQPPKLLIYWASTREPGVPDRFSGGGSGTDFTLTISSLQAEDVAVYYCQQYHSIPYTFGQGTKVEIKR

SEQ ID NO: 8933 - protein, 114 aa, Artificial Sequence
  Description of Artificial Sequence: Synthetic polypeptide
DIQMTQSPDSLAVSLGERATINCKSSQSVLSSSNNKNYLTWYQQKPGQPPKLLIYWASTRESGVPDRFSGSGSGTDFTLTISSLQAEDVAVYYCQQYYSTPYTFGQGTKVEIKR

SEQ ID NO: 8934 - protein, 113 aa, Artificial Sequence
  Description of Artificial Sequence: Synthetic polypeptide
DIVMTQSPDSLAVSLGERATINCKSSQSVLSSSNNKNYLTWYQQKPGQPPKLLIYWASTRESGVPDRFSGSGSGTDFTLTISSLQAEDVAVYYCQQYYSTPYTFGQGTKLEIK

SEQ ID NO: 8935 - protein, 108 aa, Artificial Sequence
  Description of Artificial Sequence: Synthetic polypeptide
DIQMTQSPSSLSASVGNRVTITCRASQGIRNDLGWYQQKPGKAPKRLIYAASSLQSGVPSRFSGSGSGTEFTLTISSLQPEDFATYYCLQHNSYPLTFGGGTKVEIKR

SEQ ID NO: 8936 - protein, 108 aa, Artificial Sequence
  Description of Artificial Sequence: Synthetic polypeptide
DIQMTQSPSSLSASVGNRVTITCRASQGIRNDLGWYQQKPGKAPKRLIYAASSLQSGVPSRFTGSGSGTEFTLTISSLQPEDFATYYCLQHNSYPLTFGGGTKVEIKR

SEQ ID NO: 8937 - protein, 108 aa, Artificial Sequence
  Description of Artificial Sequence: Synthetic polypeptide
NIKMIQSPSSLFASVGVTVTITCRASQGIRNNLVWYQQKPGKAPKLLIYDASSLRIWVPSRFSGSGWGAEFILPINSRQPEDYASYYCRQHNKYPFTFGQGTKMEIKR

SEQ ID NO: 8938 - protein, 108 aa, Artificial Sequence
  Description of Artificial Sequence: Synthetic polypeptide
DIQMTQSPSSLSASVGNRVTITCRASQGIRSWLAWYHQKPGKAPKLLIYAASSLQSGVPSRFSGSGSGTEFTLTISSLQPDDFATYYCQQYNSYSYTFGQGTKVEIKR

SEQ ID NO: 8939 - protein, 108 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCQQDNNYPSTFGQGTKVEIKR

SEQ ID NO: 8940 - protein, 108 aa, Artificial Sequence
  Description of Artificial Sequence: Synthetic polypeptide
DIQMTQSPSSLSASVGDRVTITCRASQGISNYLGWYQQKPGKAPKPLIYAASSLQSGVPSRFSGSGSGTDFTLTITSLQPEDFATYYCLQHNSYPFTFGRGTKVEIKR

SEQ ID NO: 8941 - protein, 114 aa, Artificial Sequence; identical to SEQ ID NO: 8895
  Description of Artificial Sequence: Synthetic polypeptide

SEQ ID NO: 8942 - protein, 108 aa, Artificial Sequence
  Description of Artificial Sequence: Synthetic polypeptide
DIQLTQSPSSLSASVGDRVTITCRASQGIRNDLGWYQQKPGKAPKRLIYAASSLQSGVPSRFSGSGSGTEFTLTISSLQPEDFATYYCLQHNSYPCTFGQGTKVEIKR

SEQ ID NO: 8943 - protein, 108 aa, Artificial Sequence
  Description of Artificial Sequence: Synthetic polypeptide
DIQLTQSPSSLSASVGNRVTITCRASQGIRNDLAWYQQKPGKAPKLLIYAASTLQTGVPSRFSGSGSGTDFTLTISSLQPEDVATYYCQKYNSAPLTFGGGTKVEIKR

SEQ ID NO: 8944 - protein, 108 aa, Artificial Sequence
  Description of Artificial Sequence: Synthetic polypeptide
DIQMTQSPSSLSASVGNRVTITCRASQGIRNDLGWYHQKPGKAPKLLIYAASSLQSGVPSRFSGSGSGTDFTLTISSLQPEDFATYYCLQDYNYPRTFGQGTKVEIKR

SEQ ID NO: 8945 - protein, 108 aa, Artificial Sequence
  Description of Artificial Sequence: Synthetic polypeptide
DIQMTQSPSSLSASVGDRVTITCRASQGIRNDLGWYHQKPGKAPKLLIYAASSLQSGVPSRFSGSGSGTEFTLTISSLQPEDFATYYCLQHNSYPLTFGRGTKVEIKR

SEQ ID NO: 8946 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIKR

SEQ ID NO: 8947 - protein, 108 aa, Artificial Sequence
  Description of Artificial Sequence: Synthetic polypeptide
DIQMTQSPSSLSASVGNRVTITCRASQGIRNDLGWYHLNPRKATKRLIYAASILQSGVPSWFIGNGSGTDFTLTISSLQPEDFATYYCLQDNSYPLTFGRGTKVEIKR

SEQ ID NO: 8948 - protein, 108 aa, Artificial Sequence
  Description of Artificial Sequence: Synthetic polypeptide
DIQMTQSPSSLSASVGNRVTITCRASQGIRNDLGWYQQKPGKAPKRLIYAASSLQSGVPSRFSGSGSGTEFTLTISSLQPEDFATYYCLQHNSYPWTFGQGTKVEIKR

SEQ ID NO: 8949 - protein, 108 aa, Artificial Sequence
  Description of Artificial Sequence: Synthetic polypeptide
DIQMTQSPSSLSASVGNRVTITCRASQGIRNDLGWYHQKPGKAPKHLIYAASSLQSGVPSRFTGSGSGTEFTLTITSLQPEDFATYYCLQHNSYPCTFGQGTKVEIKR

SEQ ID NO: 8950 - protein, 108 aa, Artificial Sequence
  Description of Artificial Sequence: Synthetic polypeptide
DIPMTQSPSSLSASVGNRVTITCRASQGFNNYLAWYHQKPGKVPNLLIYAASTLQSGVPSRFSGSGSGTDFTLTIHSLQPEDVATYYCPKYNSAPFTFGPGTKVEIKR

SEQ ID NO: 8951 - protein, 108 aa, Artificial Sequence
  Description of Artificial Sequence: Synthetic polypeptide
DIQMTQSPSSLSASVGDRVTITCRASQGISNYLAWYQQKPGKAPKLLIYAASTLQTGVPSRFTGSGSGTDFTLPINSLQPEDVATYYCQKYNRAPLTFGGGTKVEIKR

SEQ ID NO: 8952 - protein, 108 aa, Artificial Sequence
  Description of Artificial Sequence: Synthetic polypeptide
DIQLTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKR

SEQ ID NO: 8953 - protein, 108 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFTGIGSGTEFTLTITSLQPEHFATYYCLQANNYPFTFGQGTKMEIKR

SEQ ID NO: 8954 - protein, 108 aa, Artificial Sequence
  Description of Artificial Sequence: Synthetic polypeptide
DIQMTQSPSSLSASVGDRVTITCRASQGISIYLAWCQQKPGKAPKSLIYAASSLQSGVPSKFSGSGSGTEFTLTISSLQPEDFATYYCQQLNSYPLTFGRGTKLEIKR

SEQ ID NO: 8955 - protein, 113 aa, Artificial Sequence
  Description of Artificial Sequence: Synthetic polypeptide
DIVMTQTPLSSPVTLGQPASISCRSSQSLVRSDGNTYLSWLQQRPGQPPRLLIYKISNRFSGVPDRFSGSGAGTDFTLKISRVDAEDVGVYYCMQATQFPFTFGPGTKVEIKR

SEQ ID NO: 8956 - protein, 113 aa, Artificial Sequence
  Description of Artificial Sequence: Synthetic polypeptide
DIVMTQTPLSSPVTLGQPASISCRSSQSLEKSDGNTYLSWLQQRPGQPPRLLIYKISNRFSGVPDRFSGSGAGTDFTLRISRVEAEDVGIYYCVQTTQFPFTFGPGTKVEIKR

SEQ ID NO: 8957 - protein, 108 aa, Artificial Sequence
  Description of Artificial Sequence: Synthetic polypeptide
DIQLTQSPSFLSASVGNRVTITCWASQGISSYLAWYQQKPGKAPKLLIYAASTLQSGVPSRFSGSGSGTEFTLTISSLQPEDFATYYCQQLNSYPRTFGQGTKVEIKR

SEQ ID NO: 8958 - protein, 108 aa, Artificial Sequence
  Description of Artificial Sequence: Synthetic polypeptide
DIQMTQSPSSLSASVGNRVTITCRASQGISNYLACYHQKPGKVPKLLIYAASTLQSGVPSRFSGSGSGTDFTLTISSLQPEDVATYYCQKYNSAPFTFGPGTKVDIKR

SEQ ID NO: 8959 - protein, 114 aa, Artificial Sequence
  Description of Artificial Sequence: Synthetic polypeptide
DIQMTQSPDSLAVSLGERATINCKSSQSVLYSSNNKNYLAWFQQKPGQPPYLLISWASTRESGVPDRFSGSGSGTDFTLTISSLQAGDVAVYYCQQYYSIPWTFGQGTKLEIKR

SEQ ID NO: 8960 - protein, 114 aa, Artificial Sequence
  Description of Artificial Sequence: Synthetic polypeptide
AIRMTQSPDSLAMSLGERATISCKSSQSVLYSSNNKNYLAWYQQKPGQPPKLLISWASTRESGVPDRFSGSGSGTDFTLTISSLQAEDVAVYYCLQYYSIPWTFGQGTKVEIKR

SEQ ID NO: 8961 - protein, 114 aa, Artificial Sequence
  Description of Artificial Sequence: Synthetic polypeptide
DIQMTQSPDSLAVSLGERATINCKSSQNLLYSSHNKNYLTWYQQKPGQPPKLLIYWASTRESGVPDRFSGSGSGTDFTLTISSLQAEDVAVYYCQQYYTTPYTFGQGTKVEIKR

SEQ ID NO: 8962 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCQQHNSYPLTFGQGTKVEIKR

SEQ ID NO: 8963 - protein, 114 aa, Artificial Sequence
  Description of Artificial Sequence: Synthetic polypeptide
DIQMTQSPDSLAVSLGERATINCKSSQSVLYSSNNKNYLTWYQQKPGQPPKLLIYWTSTRESGVPDRFSGSGSGTDFTLTISSLQAEDVAVYYCQQYYNTPYTFGQGTKLEIKR

SEQ ID NO: 8964 - protein, 114 aa, Artificial Sequence
  Description of Artificial Sequence: Synthetic polypeptide
DIQMTQSPDSLAVSLGERATINCQSSQSVLYSSKNKNYLAWYQQKPGQPPNLLIYWASTRESGVPDRFSGSGSGTDFTLTISSLQAEDVAVYYCQQYYSTPWTFGQGTKVEIKR

SEQ ID NO: 8965 - protein, 114 aa, Artificial Sequence
  Description of Artificial Sequence: Synthetic polypeptide
DIQMTQSPDSLAVSLGERATIDCKSSQSVLSSSNNENYLTWYQQKPGQPPKLLIYWASTRESGVPDRFSGSGSGTDFTLTISSLQAEDVAVYYCQQYYSIPYTFGQGTKVEIKR

SEQ ID NO: 8966 - protein, 114 aa, Artificial Sequence
  Description of Artificial Sequence: Synthetic polypeptide
DIQMTQSPDSLAVSLGERATINCKSSQSILYSSKNKNYLAWYQQKPGQPPNLLIYWASTRESGVPDRFSGSGSGTDFTLTISSLQAEDVAFYYCHQYYSTPWTFGQGTKVEIKR

SEQ ID NO: 8967 - protein, 108 aa, Artificial Sequence
  Description of Artificial Sequence: Synthetic polypeptide
DIQMTQSPSSLSASVGDRVTITCRASQGISNYLGWYQQKPGKAPKRLMYAASSLQTGVPSRFSGSGSGTEFTLTISSLQPEDFATYYCLQHNSDPLTFGAGTKVEIKR

SEQ ID NO: 8968 - protein, 114 aa, Artificial Sequence
  Description of Artificial Sequence: Synthetic polypeptide
DIQMTQSPNSLAVSLGERASINCKSSQNILFRSHNKNFLTWYQQKPGQPPKLLIYWASTRESGVPDRFSGNGSGTDFTLTISSLQAEDVAVYYCQQYSSTPYTFGQGTKVEIKR

SEQ ID NO: 8969 - protein, 114 aa, Artificial Sequence
  Description of Artificial Sequence: Synthetic polypeptide
DIQMTQSPDSLAVSLGERATINCKSSQSVLYSSKNKNYLAWYQQKPGQSPKLVIYWASTRESGVPDRFSGSGSGTDFTLTISSLQAEDVAVYYCHQYYSSPWTFGQGTKVEIKR

SEQ ID NO: 8970 - protein, 114 aa, Artificial Sequence
  Description of Artificial Sequence: Synthetic polypeptide
DIQMTQSPDSLAVSLGERATINCKSSQSVLYSSKNKNYLAWYQQKPGQPPKLLIYWASTRESGVPDRFSGSGSGTNFTLTISGLQAEDVAVYFCQQYYSTPWTFGQGTKVEIKR

SEQ ID NO: 8971 - protein, 114 aa, Artificial Sequence
  Description of Artificial Sequence: Synthetic polypeptide
DIQMTQSPDSLAVSLGERATINCKSSQSVLSSSNNKNYLTWYQQKPGQPPKLLIYWTSTRESGVPDRFSGSGSGTDFTLTISSLQAEDVAVYYCQQYYNIPYTFGQGTKVEIKR

SEQ ID NO: 8972 - protein, 108 aa, Artificial Sequence
  Description of Artificial Sequence: Synthetic polypeptide
DIQMTQSPSSVSASVGDRVTITCRASQGIRSWLAWYQQKPGKAPKLLIYAASSLQSGVPSRFSGSGSGTDFTLTISSLQPEDFAIYYCQQVNSFPLTFGGGTKVEIKR

SEQ ID NO: 8973 - protein, 114 aa, Artificial Sequence
  Description of Artificial Sequence: Synthetic polypeptide
DIQMTQSPDSLAVSLGERATINCKSSQSVLYSSSNKNYLTWYQQKPGQPPKLLIYWASTRESGVPDRFSGSGSGTDFTLTISSLQAEDVAVYYCQQYYNIPYTFGQGTKVEIKR

SEQ ID NO: 8974 - protein, 114 aa, Artificial Sequence
  Description of Artificial Sequence: Synthetic polypeptide
DIQMTQSPDSLAVSLGERATINCKSSQSVLYSSNNKNYLTWYQQKPGQPPKLLIYWTSTRESGVPDRFSGSGSGTDFTLTISSLQAEDVAVYYCQQYFSTPYTFGQGTKVEIKR

SEQ ID NO: 8975 - protein, 108 aa, Artificial Sequence
  Description of Artificial Sequence: Synthetic polypeptide
DIQMTQSPSSVSASVGDRVTITCRASQGIRSWLAWYQQKPGKAPKLLIYAASSLQSGVPSRFSGSGSGTDFTLTISSLQPVDFATYYCQQVNSFPLTFGGGTKVEIKR

SEQ ID NO: 8976 - protein, 114 aa, Artificial Sequence
  Description of Artificial Sequence: Synthetic polypeptide
DIQMTQSPDSLAVSLGERATINCKSSQNLLYSSHNKNYLTWYQQKPGQPPKLLIYWASTRESGVPDRFSGSGSGTDFTLTISSLQAEDVAVYYCQQYYSTPYTFGQGTKVEIKR

SEQ ID NO: 8977 - protein, 114 aa, Artificial Sequence
  Description of Artificial Sequence: Synthetic polypeptide
DIQMTQSPHSLAVSLGERATINCKSSQSVLYSSKNKNYLAWYQQKPGQAPKLLIYWASTRESGVPDRFSGSGSGTDFTLTISSLQAEDVAVYYCHQYYSNPWTFGQGTKVEIKR

SEQ ID NO: 8978 - protein, 108 aa, Artificial Sequence
  Description of Artificial Sequence: Synthetic polypeptide
AIRMTQSPSSLSASVGDRVTITCRASQGISNYLAWFQQKPGKAPKSLIYAASSLQSGVPSKFSGSGSGTDFTLTISSLQPEDFATYYCQQYNSYPFTFGPGTKLEIKR

SEQ ID NO: 8979 - protein, 114 aa, Artificial Sequence
  Description of Artificial Sequence: Synthetic polypeptide
DIQMTQSPDSLAVSLGERATINCKSSQSVLYSSNNENYLTWYQQKPGQPPKLLIYWTSTRESGVPDRFSGSGSGTDFTLTISSLQAEDVAVYYCQQYYSIPYTFGQGTKVEIKR

SEQ ID NO: 8980 - protein, 108 aa, Artificial Sequence
  Description of Artificial Sequence: Synthetic polypeptide
DIQMTQSPSSVSASVGDRVTITCRASQGISSWLAWYQQKPGKAPNLLIYNASSLQSGVPSRFSGSGSGTDFTLTISSLQPEDFATYYCQQANSFPLTFGGGTKVEIKR

SEQ ID NO: 8981 - protein, 108 aa, Artificial Sequence
  Description of Artificial Sequence: Synthetic polypeptide
AIQMTQSPSSLSASVGDRVTITCRASQGIRNDLGWYQQKPGKAPKRLIYAASSLQSGVPSRFSGSGSGTEFTLTISSLQPEDFATYYCLQQNSYPLTFGGGTKVEIKR

SEQ ID NO: 8982 - protein, 108 aa, Artificial Sequence
  Description of Artificial Sequence: Synthetic polypeptide
DIQMTQSPSSLSTSVGDRVTITCRASQTISSYLDWYQQKPGKAPKLLIYAASSLQSGVPSRFSGSGSGTDLTLTITSLQPENFATYYCQQTYRAPYTFGQGTKVETKR

SEQ ID NO: 8983 - protein, 108 aa, Artificial Sequence; identical to SEQ ID NO: 8904
  Description of Artificial Sequence: Synthetic polypeptide

SEQ ID NO: 8984 - protein, 114 aa, Artificial Sequence
  Description of Artificial Sequence: Synthetic polypeptide
DIQLTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPIFTFGPGTKVEIKR

SEQ ID NO: 8985 - protein, 114 aa, Artificial Sequence
  Description of Artificial Sequence: Synthetic polypeptide
AIQMTQSPLSLSVTLGQPASISCRSSQSLVYSDGNTYLNWFQQRPGQSPRRLIYKVSNRDSGVPDRFSGSGSGTDFTLKISRVEAEDVGVYYCMQGTHWPIFTFGPGTKVEIKR

SEQ ID NO: 8986 - protein, 114 aa, Artificial Sequence
  Description of Artificial Sequence: Synthetic polypeptide
DIQMTQSPDSLAVSLGERATINCKSSQSVLYSSNNQNYLAWYQQKPGQPPNLLIYWASTRESGVPDRFSGSGSGTDFTLTISSLQAEDVAVYYCQQYYNTPYTFGQGTKVEIKR

SEQ ID NO: 8987 - protein, 108 aa, Artificial Sequence
  Description of Artificial Sequence: Synthetic polypeptide
DIQMTQSPSSLSASVGDRGTVTCRASQNIRTYLNWYQQKPGKAPKLLIYAASSLQSGVPSRFSGSGSGTDFTLTISSLQPEDFATYYCQQSYGTPYTFGQGTKVEIKR

SEQ ID NO: 8988 - protein, 114 aa, Artificial Sequence
  Description of Artificial Sequence: Synthetic polypeptide
DIQLTQSPDSLAVSLGERATINCKSSQSVLYSSNNKNYLTWYQQKPGQPPKLLIYWASTRESGVPDRFSGSGSGTDFTLTISSLQAEDVAVYYCQQFYSFPYTFGQGTKVEIKR

SEQ ID NO: 8989 - protein, 114 aa, Artificial Sequence
  Description of Artificial Sequence: Synthetic polypeptide
DIQMTQSPNSLAVSLGERATINCKSSQSVFYSSYNKNHLAWYQQKPGQPPKLLIYWASTRESGVPDRFSGSGSGTDFTLTISSLQAEDVAVYYCQQYYSTELTFGGGTKVEIKR

SEQ ID NO: 8990 - protein, 108 aa, Artificial Sequence; identical to SEQ ID NO: 8904
  Description of Artificial Sequence: Synthetic polypeptide

SEQ ID NO: 8991 - protein, 108 aa, Artificial Sequence
  Description of Artificial Sequence: Synthetic polypeptide
DIQMTQSPSSLSASVGDRGTITCRASQIINTYLNWYQQKPGKAPKLLIYAASSLQSGVPSRFSGSGSGTDFTLTISSLQPEDFATYYCQQSYSSPFTFGQGTKVEIKR

SEQ ID NO: 8992 - protein, 114 aa, Artificial Sequence
  Description of Artificial Sequence: Synthetic polypeptide
DIVMTQSPDSLAVSLGERATINCKSSQSVLYSSNNKNYLAWYQQKPGQPPKLLFYWASARESGVPDRFSGSGCGTDFTLTISSLQAEDVAVYYCHQSYNIPYTFGQGTKVEIKR

SEQ ID NO: 8993 - protein, 108 aa, Artificial Sequence
  Description of Artificial Sequence: Synthetic polypeptide
AIQMTQSPSFLSASVGDRVTITCWASQGISNYLAWYQQKPGKAPKFLIYAASTLQSGVPSRFSGSGSGTEFTLTISSLQPEDFATYYCLQLNNNLFIFGPGTKVDIKR

SEQ ID NO: 8994 - protein, 108 aa, Artificial Sequence
  Description of Artificial Sequence: Synthetic polypeptide
DIQMTQSPSSLSASVGDRVTITCRASQGISNYLAWFQQKPGKAPKYLIYAASSLHSGVPSKFSGSGSGTDFTLTISSLQPEDFATYYCQQYNSYPLTFGGGTKVEIKR

SEQ ID NO: 8995 - protein, 108 aa, Artificial Sequence
  Description of Artificial Sequence: Synthetic polypeptide
DIQMTQSPSFLSASVGDRVTITCWASQGISSYLAWYQQKPGKAPKFLIYAASTLQSGVPSRFSGSGSGTEFTLTISSLQPEDFATYYCQQLNNNLFIFGPGTKVEIKR

SEQ ID NO: 8996 - protein, 114 aa, Artificial Sequence
  Description of Artificial Sequence: Synthetic polypeptide
DIQMTQSPDSLAVSLGERATINCRSNQSVLYSSTNKNYLAWYQQKPGQPPKLLIYWASTRDSGVPDRFSGSGSGTDFTLTISSLQAEDVAIYYCQQYYSIYRTFGQGTKVEIKR

SEQ ID NO: 8997 - protein, 114 aa, Artificial Sequence; identical to SEQ ID NO: 8996
  Description of Artificial Sequence: Synthetic polypeptide

SEQ ID NO: 8998 - protein, 114 aa, Artificial Sequence
  Description of Artificial Sequence: Synthetic polypeptide
DIVMTQSPYSLAVSLGERATINCRSSQNLLYSSTNKNYLPWYQQKPGQPPKLLIYWASTRDSGVPDRFSGSGSGTDFTLTISSLQAEDVAVYYCQQYYSIYRTFGQGTKLEIKR

SEQ ID NO: 8999 - protein, 108 aa, Artificial Sequence
  Description of Artificial Sequence: Synthetic polypeptide
DIQMTQSPSSLSASVGDRGTITCRASQDIRTYLNWYQQKPGKAPKLLIYAASSLQSGVPSRFSGSGSGTDFTLTISSLQPEDFATYYCQQSYGTPYTFGQGTKVEIKR

SEQ ID NO: 9000 - protein, 114 aa, Artificial Sequence; identical to SEQ ID NO: 8886
  Description of Artificial Sequence: Synthetic polypeptide

SEQ ID NO: 9001 - protein, 114 aa, Artificial Sequence; identical to SEQ ID NO: 8973
  Description of Artificial Sequence: Synthetic polypeptide

SEQ ID NO: 9002 - protein, 114 aa, Artificial Sequence; identical to SEQ ID NO: 8899
  Description of Artificial Sequence: Synthetic polypeptide

SEQ ID NO: 9003 - protein, 113 aa, Artificial Sequence
  Description of Artificial Sequence: Synthetic polypeptide
DIVMTQSPDSLAVSLGERATINCKSSQSVLYSSNNQNYLAWYQQKPGQPPKLLIYWASTRESGVPDRFSGSGSGTDFTLTISSLQAEDVAVYYCQQYYSTPYTFGQGTKLEIK

SEQ ID NO: 9004 - protein, 108 aa, Artificial Sequence; identical to SEQ ID NO: 8900
  Description of Artificial Sequence: Synthetic polypeptide

SEQ ID NO: 9005 - protein, 108 aa, Artificial Sequence; identical to SEQ ID NO: 8987
  Description of Artificial Sequence: Synthetic polypeptide

SEQ ID NO: 9006 - protein, 107 aa, Artificial Sequence
  Description of Artificial Sequence: Synthetic polypeptide
DIQMTQSPSSVSASVGDRVTITCRSSQDINNWLVWYQQKPGKAPKVLIYGASRLQSGVPSRFSGSGSGTDFTLTISSLQPEDFATYYCQQANSFPLTFGGGTKVEIK

SEQ ID NO: 9007 - protein, 114 aa, Artificial Sequence
  Description of Artificial Sequence: Synthetic polypeptide
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIKR

SEQ ID NO: 9008 - protein, 107 aa, Artificial Sequence
  Description of Artificial Sequence: Synthetic polypeptide
DIQMTQSPSSLSASVGDRGTITCRASQDIRTYLNWYQQKPGKAPKLLIYAASSLQSGVPSRFSGSGSGTDFTLTISSLQPEDFATYYCQQSYGTPYTFGQGTKLEIK

SEQ ID NO: 9009 - protein, 108 aa, Artificial Sequence; identical to SEQ ID NO: 8942
  Description of Artificial Sequence: Synthetic polypeptide

SEQ ID NO: 9010 - protein, 112 aa, Artificial Sequence
  Description of Artificial Sequence: Synthetic polypeptide
DIVMTQTPLSSPVTLGQPASISCRSSQSLVRSDGNTYLSWLQQRPGQPPRLLIYKISNRFSGVPDRFSGSGAGTDFTLKISRVEADDVGVYYCMQTTQFPFTFGPGTKVDIK

SEQ ID NO: 9011 - protein, 112 aa, Artificial Sequence
  Description of Artificial Sequence: Synthetic polypeptide
DIVMTQTPLSSPVTLGQPASISCRSSHSLVRSDGNTYLSWLQQRPGQPPRLLIYKISNRFSGVPDRFSGTGAGTDFTLKINRVEAEDVGFYYCMQATQFPFTFGPGTKVDIK

SEQ ID NO: 9012 - protein, 108 aa, Artificial Sequence
  Description of Artificial Sequence: Synthetic polypeptide
DIQMTQSPSFLSASVGDRVTITCWASQGISSYLAWYQQKPGKAPKLLIYASSTLQSGVPSRFSGSGSGTEFTLTISSLQPEDFATYYCQQFNSYPPTFGQGTKVEIKR

SEQ ID NO: 9013 - protein, 112 aa, Artificial Sequence
  Description of Artificial Sequence: Synthetic polypeptide
DIVMTQTPLSSPVTLGQPASISCRSSQSLVHSDGNTYLSWLQQRPGQPPRLLIYKISNRFSGVPDRFIGSGAGTDFTLRISRVEAEDVGVYYCMQATQFPFTFGPGTRVDIK

SEQ ID NO: 9014 - protein, 107 aa, Artificial Sequence
  Description of Artificial Sequence: Synthetic polypeptide
EIVLTQSPATLSLSPGERVTLSCRASQSVSSYLAWYQQKPGQAPRLLIYDASNRATGIPARFSGSGSGTDFTLTISSLEPEDFAVYYCQQRNIWPPTFGQGTKVEIK

SEQ ID NO: 9015 - protein, 112 aa, Artificial Sequence
  Description of Artificial Sequence: Synthetic polypeptide
DIVMTQTPLSSPVTLGQPASISCRSSQSLVRSDGNTYLSWLQQRPGQPPRLLIYKISNRFSGVPDRFSGSGAGTDFTLKISRVEAEDVGIYFCMQTTQFPFTFGPGTKVDIK

SEQ ID NO: 9016 - protein, 108 aa, Artificial Sequence
  Description of Artificial Sequence: Synthetic polypeptide
DIRMTQSPSSLSASVGDRGTITCRASQNINSYLNWYQLKPGKAPKLLIFAASSLQSGVPSRFSGSGSGTDFTLTISSLQPEDFATYYCQQSYSSPFTFGQGTKVEIKR

SEQ ID NO: 9017 - protein, 112 aa, Artificial Sequence; identical to SEQ ID NO: 9015
  Description of Artificial Sequence: Synthetic polypeptide

SEQ ID NO: 9018 - protein, 113 aa, Artificial Sequence; identical to SEQ ID NO: 8890
  Description of Artificial Sequence: Synthetic polypeptide

SEQ ID NO: 9019 - protein, 108 aa, Artificial Sequence
  Description of Artificial Sequence: Synthetic polypeptide
DIQMTQSPSSLSASVGDRVTITCRASQDIRNDLGWYQQKPGNAPKLLIYSTSSLQSGVPSRFSGSGSGTDFTLTISSLQPEDFATYYCLQDYNYPLTFGGGTKVEIKR

SEQ ID NO: 9020 - protein, 109 aa, Artificial Sequence
  Description of Artificial Sequence: Synthetic polypeptide
DIVMTQSPDSLAVSLGERATIKCKSSQSVLYSSNNKNYLAWYQQKPGQPPNLLIYWASTRESGVPDRFSGSGSGTDFTLTISSLQAEDVAVYYCQQYFSFGQGTKVEIK

SEQ ID NO: 9021 - protein, 107 aa, Artificial Sequence
  Description of Artificial Sequence: Synthetic polypeptide
DIQMTQSPSSLSASVGDRGTVTCRASQNIRTYLNWYQQKPGKAPKLLIYAASSLQSGVPSRFSGSGSGTDFTLTISSLQPEDFATYYCQQSYGTPYTFGQGTKLEIK

SEQ ID NO: 9022 - protein, 113 aa, Artificial Sequence
  Description of Artificial Sequence: Synthetic polypeptide
DIVMTQSPDSLAVSLGERATINCKSSQSVLYSSNNKNYLGWYQQKAGQPPKLLIYWASTRESGVPDRFSGSGSGTDFTLTISSLQAEDVAVYYCQQYYGIPWTFGQGTKVEIK

SEQ ID NO: 9023 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK

SEQ ID NO: 9024 - protein, 107 aa, Artificial Sequence
  Description of Artificial Sequence: Synthetic polypeptide
AIQMTQSPSSLSASVGDRVTITCRASQDIRNDLGWYQQKPGNAPKLLIYSTSSLQSGVPSRFSGSGSGTDFTLTISSLQPEDFATYYCLQDYNYPLTFGGGTKVEIK

SEQ ID NO: 9025 - protein, 108 aa, Artificial Sequence
  Description of Artificial Sequence: Synthetic polypeptide
DIQMTQSPSSLSASVGDRVTITCRASQGISNYLAWFQQKPGKAPKSLIYAASSLQGGVPSRFSGSGSGTDFTLTISSLQPEDFATYYCQQYNSYPLTFGGGTKVEIKR

SEQ ID NO: 9026 - protein, 107 aa, Artificial Sequence
  Description of Artificial Sequence: Synthetic polypeptide
DIQMTQSPSSLSASVGDRVTITCRASQGISNYLAWFQQKPGKAPKSLIYAASSLQGGVPSRFSGSGSGTDFTLTISSLQPEDFATYYCQQYNSYPLTFGGGTKVEIK

SEQ ID NO: 9027 - protein, 113 aa, Artificial Sequence
  Description of Artificial Sequence: Synthetic polypeptide
DIVMTQSPLSLPVTPGEPASISCRSSQSLLHSNGNTYLHWYLQKPGQSPQLLIYTVSNRFSGVPDRFSGSGSGTDFTLKISRVEAEDVGVYYCSQSTHVPYTFGGGTKVEIKR

SEQ ID NO: 9028 - protein, 113 aa, Artificial Sequence; identical to SEQ ID NO: 9027
  Description of Artificial Sequence: Synthetic polypeptide

SEQ ID NO: 9029 - protein, 113 aa, Artificial Sequence; identical to SEQ ID NO: 9027
  Description of Artificial Sequence: Synthetic polypeptide

SEQ ID NO: 9030 - protein, 108 aa, Artificial Sequence
  Description of Artificial Sequence: Synthetic polypeptide
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKR

SEQ ID NO: 9031 - protein, 127 aa, Artificial Sequence
  Description of Artificial Sequence: Synthetic polypeptide
MESQIQAFVFVFLWLSGVDGDIVMTQSHKFMSTSVGDRVSFTCKASQDVFTAVAWYQQKPGQSPKLLIYWASTRRTGVPDRFTGSGSGTDYTLTISSVQAEDLALYYCQQHFSTPPTFGGGTKLEIK

SEQ ID NO: 9032 - protein, 133 aa, Artificial Sequence
  Description of Artificial Sequence: Synthetic polypeptide
MESQTQVLMSLLFWVSGTCGDIVMTQSPSSLTVTAGEKVTMSCKSSQSLLNSGNQKNYLTWYQQKPGQPPKLLIYWASTRESGVPDRFTGSGSGTDFSLTISSVQAEDLAIYYCQNDYSYPFTFGSGTKLEIK

SEQ ID NO: 9033 - protein, 90 aa, Artificial Sequence
  Description of Artificial Sequence: Synthetic polypeptide
DIQMTQSPSSLSASVGDRVTITCRASGNIYGWLAWYQQTPGKAPKLLIYQAKTLMDGVPSRFSGSGSGTDYTFTISSLQPEDIATYYCQH

SEQ ID NO: 9034 - protein, 107 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQIT

SEQ ID NO: 9035 - protein, 107 aa, Artificial Sequence; identical to SEQ ID NO: 9034
  Description of Artificial Sequence: Synthetic polypeptide

SEQ ID NO: 9036 - protein, 107 aa, Artificial Sequence; identical to SEQ ID NO: 9034
  Description of Artificial Sequence: Synthetic polypeptide

SEQ ID NO: 9037 - protein, 107 aa, Artificial Sequence; identical to SEQ ID NO: 9034
  Description of Artificial Sequence: Synthetic polypeptide

SEQ ID NO: 9038 - protein, 108 aa, Artificial Sequence
  Description of Artificial Sequence: Synthetic polypeptide
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLEIKR

SEQ ID NO: 9039 - protein, 107 aa, Artificial Sequence; identical to SEQ ID NO: 9034
  Description of Artificial Sequence: Synthetic polypeptide

SEQ ID NO: 9040 - protein, 107 aa, Artificial Sequence
  Description of Artificial Sequence: Synthetic polypeptide
DIQMTQSPSSLSASVGDRVTITCRASGNIYTYLTWYQQTPGKAPKLLIYNAKTLADGVPSRFSGSGSGTDYTFTISSLQPEDIATYYCQHFWTLPYTFGQGTKLQIT

SEQ ID NO: 9041 - protein, 108 aa, Artificial Sequence
  Description of Artificial Sequence: Synthetic polypeptide
SVVMTQTPKFLLVSAGDRVTITCKASQSVSNDVAWYQQKPGQSPKLLIYYASNRYTGVPDRFTGSGYGTDFTFIISTVRAEDLAVYFCQQDYNSPWTFGGGTKLEIKR

SEQ ID NO: 9042 - protein, 108 aa, Artificial Sequence
  Description of Artificial Sequence: Synthetic polypeptide
SVVMTQTPKFLLVSAGDRVTITCKASQSVSNDVAWFQQKPGQSPKLLIYYASNRYTGVPDRFTGSGYGTDFTFTISTVQAEDLAVYFCQQDYNSPWTFGGGTKLEIKR

SEQ ID NO: 9043 - protein, 108 aa, Artificial Sequence
  Description of Artificial Sequence: Synthetic polypeptide
SIVMTQTPKFLLVSAGDRVTITCKASQSVSNDVAWYQQKSGQSPKLLIYYASNRYTGVPDRFTGSGYGTDFTFTISTVQPEDLAVYFCQQDYTSPFTFGSGTKLEIKR

SEQ ID NO: 9044 - protein, 108 aa, Artificial Sequence
  Description of Artificial Sequence: Synthetic polypeptide
SIVMTQTPKFLLVSAGDRVTITCKASQSVSNDVAWYQQKPGQSPKLLIYYASNRYTGVPDRFTGSGYGTDFTFTITTVQAEDLAVYFCQQDYSSPWSFGGGTKLEIKR

SEQ ID NO: 9045 - protein, 108 aa, Artificial Sequence
  Description of Artificial Sequence: Synthetic polypeptide
SIVMTQSPKFLLVSAGDRVTITCKASQSVSNDVAWYQQKLGQSPKLLIYYASNRYTGVPDRFTGSGYGTDFTFTINTVQAEDLAVYFCQQDYTSPYTFGGGTKLEIQR

SEQ ID NO: 9046 - protein, 108 aa, Artificial Sequence
  Description of Artificial Sequence: Synthetic polypeptide
DIVMTQSQKFMSTSVGDRVSVTCKASQNVGTNVAWYQQKPGQSPKGLIYSASHRYSGVPDRFAGSGSGTDFTLTISNVQSEDLAEYFCQQYNSYPLTFGGGTKLELKR

SEQ ID NO: 9047 - protein, 108 aa, Artificial Sequence
  Description of Artificial Sequence: Synthetic polypeptide
SFVMTQTPKFLLVSAGDRVTITCKASQSVSNDVAWYQQKPGQSPKLLIYYASNRYTGVPDRFTGTGYGTDFTFTISTVQAEDLAVYFCQQDYTSPFTFGSGTKLEIKR

SEQ ID NO: 9048 - protein, 112 aa, Artificial Sequence
  Description of Artificial Sequence: Synthetic polypeptide
DIVLTQSPGSLAVSLGQRATISCRASESVDNYGISFMNWFQQKPGQPPKLLIYAASNQGSGVPARFSGSGSGTDFSLDIHPMEEDDTAMYFCQQSKEVPPTFGGGTKLEIKR

SEQ ID NO: 9049 - protein, 108 aa, Artificial Sequence
  Description of Artificial Sequence: Synthetic polypeptide
SVVMTQTPKFLLVSAGDRVTMTCKASQSVSNDVAWFQQKPGQSPKLLIYYASNRYTGVPDRFTGSGYGTDFTFTISTVQAEDLAVYFCQQDYNSPWTFGGGTKLEIKR

SEQ ID NO: 9050 - protein, 108 aa, Artificial Sequence
  Description of Artificial Sequence: Synthetic polypeptide
DIVLSQSPATLSVTPGDSVSLSCRASQSISKNLHWYQQKSHESPRLLIKYTSQSISGIPSRFSGSGSGTDFTLSINSVETEDFGMYFCQQSISWPLTFGAGTKLELKR

SEQ ID NO: 9051 - protein, 112 aa, Artificial Sequence
  Description of Artificial Sequence: Synthetic polypeptide
DIVMTQSPDSLSVSLGERATINCRASKSVDSYGNSFMHWYQQKPGQPPKLLIYLASNLESGVPDRFSGSGSGTDFTLTISSLQAEDVAVYYCQQNNEDPRTFGGGTKVEIKR

SEQ ID NO: 9052 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTRLEIKR

SEQ ID NO: 9053 - protein, 112 aa, Artificial Sequence
  Description of Artificial Sequence: Synthetic polypeptide
DIVMSQSPSSLAVSAGEKVTMSCKSSQSLLDSRTRKNYLVWYQQKPGQSPKLLIYWASTRGSGVPDRFTGSGSGTDFTLTISSVQAEDLAVYYCKQSYNLRTFGGGTKLEIK

SEQ ID NO: 9054 - protein, 112 aa, Artificial Sequence; identical to SEQ ID NO: 9053
  Description of Artificial Sequence: Synthetic polypeptide

SEQ ID NO: 9055 - protein, 112 aa, Artificial Sequence
  Description of Artificial Sequence: Synthetic polypeptide
DVVMTQVPLSLPVSLGDQASISCRSSQRLVHSNGNTYLHWFLQKPGQSPKLLIYTVSNRFSGVPDRFSGSGSGTDFTLKISRVEAEDLGVYFCSQSTLVPWTFGGGTKLEIK

SEQ ID NO: 9056 - protein, 112 aa, Artificial Sequence
  Description of Artificial Sequence: Synthetic polypeptide
DAVLTQTPLSLPVSLGDQASISCTSSQSLVHSNGNTYLHWYLQKPGQSPKLLIYKVSDRFSGVPDRFSGSGSGTDFTLMITRVEAEDLGVYFCSQSSLVPWTFGGGTKLEVK

SEQ ID NO: 9057 - protein, 106 aa, Artificial Sequence
  Description of Artificial Sequence: Synthetic polypeptide
ENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGSGTKLEIK

SEQ ID NO: 9058 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKFLIYKVSNRFSGVPDRFSGSGSGTDFTLKINRVEAEDLGIYYCFQGSHVPWTFGGGTKLEIK

SEQ ID NO: 9059 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPWTFGGGTKLEIK

SEQ ID NO: 9060 - protein, 108 aa, Artificial Sequence
  Description of Artificial Sequence: Synthetic polypeptide
DIQMTQSPSSLSASVGDRVTITCRASQDISNCLNWYQQKPGKAPKLLIYYTSRLHSGVPSRFSGSGSGTDFTFTISSLQPEDIATYYCQQGKTLPYAFGQGTKLEIKR

SEQ ID NO: 9061 - protein, 107 aa, Artificial Sequence
  Description of Artificial Sequence: Synthetic polypeptide
DIQMTQSPSSLSASVGDRVTITCRASQDISNCLNWYQQKPGKTVKLLIYYTSRLHSGVPSRFSGSGSGTDYTFTISSLQPEDIATYFCQQGKTLPYAFGQGTKLEIK

SEQ ID NO: 9062 - protein, 107 aa, Artificial Sequence
  Description of Artificial Sequence: Synthetic polypeptide
NIQMTQTPSSLSASVGDRVTITCRASQDISNCLNWYQQKPGKTVKLLIYYTSRLHSGVPSRFSGSGSGTDYTFTISSLQPEDIATYFCQQGKTLPYAFGQGTKLEIK

SEQ ID NO: 9063 - protein, 107 aa, Artificial Sequence
  Description of Artificial Sequence: Synthetic polypeptide
DIQMTQSPSSLSASVGDRVTITCRASQDISNCLNWYQQKPGKTPKLLIYYTSRLHSGVPSRFSGSGSGTDYTFTISSLQPEDIATYFCQQGKTLPYAFGQGTKLEIK

SEQ ID NO: 9064 - protein, 108 aa, Artificial Sequence
  Description of Artificial Sequence: Synthetic polypeptide
DIQMTQSPSSLSASVGDRVTITCRASQDISNCLNWYQQKPGKAPKLLIYYTSRLHSGVPSRFSGSGSGTDFTFTISSLQPEDIATYYCQQGKTLPYAFGGGTKVEIKR

SEQ ID NO: 9065 - protein, 107 aa, Artificial Sequence
  Description of Artificial Sequence: Synthetic polypeptide
DIQMTQSPSSLSASVGDRVTITCRASQDISNCLNWYQQKPGKTVKLLIYYTSRLHSGVPSRFSGSGSGTDYTFTISSLQPEDIATYFCQQGKTLPYAFGGGTKVEIK

SEQ ID NO: 9066 - protein, 107 aa, Artificial Sequence
  Description of Artificial Sequence: Synthetic polypeptide
NIQMTQTPSSLSASVGDRVTITCRASQDISNCLNWYQQKPGKTVKLLIYYTSRLHSGVPSRFSGSGSGTDYTFTISSLQPEDIATYFCQQGKTLPYAFGGGTKVEIK

SEQ ID NO: 9067 - protein, 107 aa, Artificial Sequence
  Description of Artificial Sequence: Synthetic polypeptide
DIQMTQSPSSLSASVGDRVTITCRASQDISNMLNWYQQKPGKTPKLLIYYTSRLYPGVPSRFSGSGSGTDYTFTISSLQPEDIATYFCQQGKTLPYAFGQGTKLEIK

SEQ ID NO: 9068 - protein, 107 aa, Artificial Sequence
  Description of Artificial Sequence: Synthetic polypeptide
DIQMTQSPSSLSASVGDRVTITCRASQDISNRLNWYQQKPGKAPKLLIYYASRLKPGVPSRFSGSGSGTDYTFTISSLQPEDIATYFCQQGNTPPYTFGQGTKLEIK

SEQ ID NO: 9069 - protein, 107 aa, Artificial Sequence
  Description of Artificial Sequence: Synthetic polypeptide
DIQMTQSPSSLSASVGDRVTITCRASQDISNMLNWYQQKPGKAPKLLIYYTSRLKPGVPSRFSGSGSGTDYTFTISSLQPEDIATYFCQQGKTAPYTFGQGTKLEIK

SEQ ID NO: 9070 - protein, 107 aa, Artificial Sequence
  Description of Artificial Sequence: Synthetic polypeptide
DIQMTQSPSSLSASVGDRVTITCRASQDISNMLNWYQQKPGKTPKLLIYYTSRLRSGVPSRFSGSGSGTDYTFTISSLQPEDIATYFCQQGKKPPYTFGQGTKLEIK

SEQ ID NO: 9071 - protein, 122 aa, Artificial Sequence; identical to SEQ ID NO: 6683
  Description of Artificial Sequence: Synthetic polypeptide

SEQ ID NO: 9072 - protein, 107 aa, Artificial Sequence
  Description of Artificial Sequence: Synthetic polypeptide
ETTVTQSPSSLSASVGDRVTITCITSTDIDVDMNWYQQKPGKPPKLLISQGNTLRPGVPSRFSSSGSGTDFTFTISSLQPEDFATYYCLQSDNLPLTFGQGTKLEIK

SEQ ID NO: 9073 - protein, 107 aa, Artificial Sequence
  Description of Artificial Sequence: Synthetic polypeptide
DTVVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIK

SEQ ID NO: 9074 - protein, 107 aa, Artificial Sequence
  Description of Artificial Sequence: Synthetic polypeptide
ETTVTQSPAFLSVTPGEKVTITCITSTDIDVDMNWYQQKPDQPPKLLISQGNTLRPGVPSRFSSSGSGTDFTFTISSLEAEDAATYYCLQSDNLPLTFGQGTKLEIK

SEQ ID NO: 9075 - protein, 112 aa, Artificial Sequence [sequence omitted]

SEQ ID NO: 9076 - protein, 106 aa, Artificial Sequence [sequence omitted]

SEQ ID NO: 9077 - protein, 106 aa, Artificial Sequence [sequence omitted]

SEQ ID NO: 9078 - protein, 107 aa, Artificial Sequence
  Description of Artificial Sequence: Synthetic polypeptide
DIQMTQSPSSVSASVGDRVTITCRASQGISSWLAWYQQKPGKAPKLLIYGASSLESGVPSRFSGSGSGTDFTLTISSLQPEDFASYYCQQANSFPYTFGQGTKLEIK

SEQ ID NO: 9079 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYSPHSVVFGGGTKLTVLGE

SEQ ID NO: 9080 - protein, 98 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYSVVFGGGT

SEQ ID NO: 9081 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYDPRVVVFGGGTKLTVLGE

SEQ ID NO: 9082 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYDPTNQVFGGGTKLTVLGE

SEQ ID NO: 9083 - protein, 118 aa, Artificial Sequence; identical to SEQ ID NO: 6696
  Description of Artificial Sequence: Synthetic polypeptide

SEQ ID NO: 9084 - protein, 155 aa, Artificial Sequence
  Description of Artificial Sequence: Synthetic polypeptide
MTPGKTSLVLLLLLLSLEAIVKAGIAIPRNSGCPNSEDKNFPRTVMVNLNIHNRNTSTNPKRSSDYYNRSTSPWNLHRNEDPERYPSVIWEAKCRHLGCVKADGNVDYHMNSVPIQQEILVLRREPRHCPNSFRLEKILVSVGCTCVTPIVHHVA

SEQ ID NO: 9085 - protein, 112 aa, Artificial Sequence
  Description of Artificial Sequence: Synthetic polypeptide
NFMLTQPHSVSESPGKTVTISCTRSSGSLANYYVQWYQQRPGSSPTIVIFANNQRPSGVPDRFSGSIDSSSNSASLTISGLKTEDEADYYCQSYDPHSVVFGGGTKLTVLGE

SEQ ID NO: 9086 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIASSSNSASLTISRLKTEDEADYYCQSYSPHSVVFGGGTKLTVLGE

SEQ ID NO: 9087 - protein, 112 aa, Artificial Sequence; identical to SEQ ID NO: 6694
  Description of Artificial Sequence: Synthetic polypeptide

SEQ ID NO: 9088 - protein, 92 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSALKTEDEADYKDIVFGGGT

SEQ ID NO: 9089 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYSPSSVVFGGGTKLTVLGE

SEQ ID NO: 9090 - protein, 112 aa, Artificial Sequence
  Description of Artificial Sequence: Synthetic polypeptide
NFMLTQPHSVSESPGKTVTISCTRSSGSLANYYVQWYQQRPGSSPTIVIFANNQRPSGVPDRFSGSIDSSSNSASLTISGLKTEDEADYYCQTYDPYSVVFGGGTKLTVLGE

SEQ ID NO: 9091 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYDDSSVVFGGGTKLTVLGE

SEQ ID NO: 9092 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYNHKDIVFGGGTKLTVLGE

SEQ ID NO: 9093 - protein, 112 aa, Artificial Sequence; identical to SEQ ID NO: 9079
  Description of Artificial Sequence: Synthetic polypeptide

SEQ ID NO: 9094 - protein, 112 aa, Artificial Sequence
  Description of Artificial Sequence: Synthetic polypeptide
NFMLTQPHSVSESPGKTVTISCTRSSGSLANYYVQWYQQRPGSAPTIVIFANNQRPSGVPDRFSGSIDSSSNSASLTISRLKTEDEADYYCQSYDPHSVVFGGGTKLTVLGE

SEQ ID NO: 9095 - protein, 108 aa, Artificial Sequence
  Description of Artificial Sequence: Synthetic polypeptide
EIVLTQSPGTLSLSPGERATLSCRASQSVSSGHLAWYQQKPGQAPRLLIYGASSRATGIPGRFSGSGSGTDFTLTISRLEPEDFAVYYCQQYGSSPYTFGQGTKLEIK

SEQ ID NO: 9096 - protein, 108 aa, Artificial Sequence
  Description of Artificial Sequence: Synthetic polypeptide
EIVLTQSPAILSLSPGERATLSCRASQSVSSYLAWYQQKPGQAPRLLIYDASNRATGIPARFSGSGSGTDFTLTISSLEPEDFAVYYCQQRSNWPPLTFGGGTKVEIK

SEQ ID NO: 9097 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPFTFGPGTKVDIK

SEQ ID NO: 9098 - protein, 107 aa, Artificial Sequence
  Description of Artificial Sequence: Synthetic polypeptide
AIQLTQSPSSLSASVGDRVTITCRASQGISSALAWYQQKPGKAPKLLIYDASSLESGVPSRFSGSGSGTDFTLTISSLQPEDFATYYCQQFDSFPHTFGGGTKVEIK

SEQ ID NO: 9099 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIK

SEQ ID NO: 9100 - protein, 107 aa, Artificial Sequence
  Description of Artificial Sequence: Synthetic polypeptide
EVVLTQSPGTLSLSPGERATLSCRASQSISSGYLAWYQQKPGQAPRLLIYGASSRATGIPDRFSGSGSGTDFTLTISRLEPEDFAVYYCQQYGSSPTFGGGTKVEIK

SEQ ID NO: 9101 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPYTFGQGTKLEIK

SEQ ID NO: 9102 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIK

SEQ ID NO: 9103 - protein, 108 aa, Artificial Sequence
  Description of Artificial Sequence: Synthetic polypeptide
EIVLTQSPATLSLSPGERATLSCRASQSVSSYVAWYQQKPGQAPRLLIYDASNRATGIPARFSGSGSGTDFTLTISSLEPEDFAIYYCQQRSNSPPWTFGQGTKVEIK

SEQ ID NO: 9104 - protein, 109 aa, Artificial Sequence; identical to SEQ ID NO: 9097
  Description of Artificial Sequence: Synthetic polypeptide

SEQ ID NO: 9105 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPEYTFGQGTKLEIK

SEQ ID NO: 9106 - protein, 107 aa, Artificial Sequence
  Description of Artificial Sequence: Synthetic polypeptide
EIVLTQSPATLSLSPGERATLSCQASQSISNFLHWYQQRPGQAPRLLIRYRSQSISGIPARFSGSGSGTDFTLTISSLEPEDFAVYYCQQSGSWPLTFGGGTKVEIK

SEQ ID NO: 9107 - protein, 107 aa, Artificial Sequence [sequence omitted]

SEQ ID NO: 9108 - protein, 109 aa, Artificial Sequence
  Description of Artificial Sequence: Synthetic polypeptide
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRT

SEQ ID NO: 9109 - protein, 107 aa, Artificial Sequence
  Description of Artificial Sequence: Synthetic polypeptide
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIK

SEQ ID NO: 9110 - protein, 107 aa, Artificial Sequence
  Description of Artificial Sequence: Synthetic polypeptide
DIQMTQTTSSLSASLGDRVTISCSSSQDISNYLNWYQQKPDGTVKVLIYYTSTLHLGVPSRFSGSGSGTDYSLTISNLELEDIATYYCQQYYNLPWTFGGGTKLEIK

SEQ ID NO: 9111 - protein, 107 aa, Artificial Sequence
  Description of Artificial Sequence: Synthetic polypeptide
DIQMTQSPSFLSASVGDSVAITCRASQDISRYLAWYQQRPGKAPKLLIYDASNLQTGVPSRFSGSGSGTDFTFTITSLQPEDFGTYYCQQYDTLHPSFGPGTTVDIK

SEQ ID NO: 9112 - protein, 107 aa, Artificial Sequence
  Description of Artificial Sequence: Synthetic polypeptide
DIQMTQTTSSLSASLGDRVTISCRASQDISKYLNWYQQQPDGTIKLLIYYTSRLHSGVPSRFSGRGSGTDYSLTISNVEQEDIATYFCQQGSTLPYTFGGGTKLEIK

SEQ ID NO: 9113 - protein, 107 aa, Artificial Sequence
  Description of Artificial Sequence: Synthetic polypeptide
DIQMTQTTSSLSASLGDRVTISCRASQDINKYLNWYQQQPDGTVKLLIYYTSRLHSGVPSRFSGRGSGTDYSLTISNLEQEDIATYFCQQGSTLPYTFGGGTKLEIK

SEQ ID NO: 9114 - protein, 107 aa, Artificial Sequence
  Description of Artificial Sequence: Synthetic polypeptide
DIQMTQTTSSLSASLGDRVTFSCRASQDISKYLNWYQQQPDGTIKLLIYYTSRLHSGVPSRFSGRGSGTDYSLTITNLEQEDIATYFCQQGSALPYTFGGGTKLEIK

SEQ ID NO: 9115 - protein, 107 aa, Artificial Sequence
  Description of Artificial Sequence: Synthetic polypeptide
DIQMTQTTSSLSASLGDRVTISCRASQDISKYLNWYQQQPDGTVKLLIYYTSRLHSGVPSRFSGRGSGTDYSLTISNLEQEDIATYFCQQGSTLPYTFGGGTKLEIK

SEQ ID NO: 9116 - protein, 107 aa, Artificial Sequence
  Description of Artificial Sequence: Synthetic polypeptide
DIQMTQTTSSLSASLGDRVTISCRASQDISKYLNWYQQQPDGTIKLLIYYTSRLHSGVPSRFSGRGSGTDYSLTITNLEQEDIATYFCQQGSALPYTFGGGTKLEIK

SEQ ID NO: 9117 - protein, 107 aa, Artificial Sequence
  Description of Artificial Sequence: Synthetic polypeptide
DIQMTQSPSSLSASVGDRVTITCRASQDISKYLNWYQQKPGKAPKLLIYYTSSLQSGVPSRFSGSGSGTDFTLTISSLQPEDFATYYCQQGSTLPYTFGGGTKVEIK

SEQ ID NO: 9118 - protein, 107 aa, Artificial Sequence
  Description of Artificial Sequence: Synthetic polypeptide
DIQMTQSPSSLSASVGDRVTISCRASQDISKYLNWYQQKPGKAPKLLIYYTSRLHSGVPSRFSGRGSGTDYSLTISNLQPEDFATYFCQQGSTLPYTFGGGTKVEIK

SEQ ID NO: 9119 - protein, 214 aa, Artificial Sequence
  Description of Artificial Sequence: Synthetic polypeptide
DIQMTQSPSSLSASVGDRVTITCRASQDISKYLNWYQQKPGKAPKLLIYYTSSLQSGVPSRFSGSGSGTDFTLTISSLQPEDFATYYCQQGSTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9120 - protein, 214 aa, Artificial Sequence
  Description of Artificial Sequence: Synthetic polypeptide
DIQMTQSPSSLSASVGDRVTISCRASQDISKYLNWYQQKPGKAPKLLIYYTSRLHSGVPSRFSGRGSGTDYSLTISNLQPEDFATYFCQQGSTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9121 - protein, 145 aa, Artificial Sequence
  Description of Artificial Sequence: Synthetic polypeptide
MESQFLFLLVLWIRETNGDVVMTQTPLSLSVTIGQPASISCKSSQSLLDSAGKTYLSWLLQRPGQSPKRLIYLVSKLDSGVPDRFTGSGSGTDFTLKISRVEAEDLGVYYCWQGTHFPWTFGGGTKLEIKRADAAPTVSIFPPSS

SEQ ID NO: 9122 - protein, 147 aa, Artificial Sequence
  Description of Artificial Sequence: Synthetic polypeptide
MVSSAQFLFLLVLWIRETNGDVVMTQTPLSLSVTIGQPASISCKSSQSLLDSAGKTYLSWLLQRPGQSPKRLIYLVSKLDSGVPDRFTGSGSGTDFTLKISRVEAEDLGVYYCWQGTHFPWTFGGGTKLEIKRADAAPTVSIFPPSS

SEQ ID NO: 9123 - protein, 146 aa, Artificial Sequence
  Description of Artificial Sequence: Synthetic polypeptide
MKLPVRLLVLMFWIPASSSDVLMTQTPLSLPVSLGDQASISCKSSQSIVHSNGNTYLEWYLQKPGQSPKLLIYKVFNRFSGVPDRFSGSGSGTDFTLKISRVEAEDLGVYYCFQGSHVPYTFGGGTKLEIKRADAAPTVSIFPPSS

SEQ ID NO: 9124 - protein, 108 aa, Artificial Sequence [sequence omitted]

SEQ ID NO: 9125 - protein, 107 aa, Artificial Sequence
  Description of Artificial Sequence: Synthetic polypeptide
DIQMTQSPSSLSASVGDRVTITCRSSQRIMTYLNWYQQKPGKAPKLLIFVASHSQSGVPSRFRGSGSETDFTLTISGLQPEDSATYYCQQSFWTPLTFGGGTKVEIK

SEQ ID NO: 9126 - protein, 112 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 9127 - protein, 108 aa, Artificial Sequence
  Description of Artificial Sequence: Synthetic polypeptide
DIQMTQSPASLSASVGETVTITCRTSENIYSYLAWYQQKPGKSPHLLVYNTKTLAEGVPSRFSGSGSGTQFSLKINSLQPEDFGSYYCQHHYDSPLTFGSGTKLELKR

SEQ ID NO: 9128 - protein, 108 aa, Artificial Sequence
  Description of Artificial Sequence: Synthetic polypeptide
DIQMTQSPASLSASVGETVTITCRASENFYSYLAWYQQKQGKSPQLLVYNAKTLAEGVPSRFSGSGSGTQFSLKINSLQPEDFGTYYCQHHYDIPLTFGAGTKLELKR

SEQ ID NO: 9129 - protein, 114 aa, Artificial Sequence
  Description of Artificial Sequence: Synthetic polypeptide
DIVMTQSPSSLSVSAGEKVTLSCKSSQSLLISGDQKNYLAWYQQKPGQPPKLLIYGASTRDSGVPDRFTGSGSGADFTLTISSVQAEDLAVYYCQNDHSFPPTFGAGTKLELKR

SEQ ID NO: 9130 - protein, 108 aa, Artificial Sequence
  Description of Artificial Sequence: Synthetic polypeptide
DTVMTQSHKFMSTSVGDRVSITCKASQDVSSAVAWYQQKPGQSPKLLIYSASYRYTGVPDRFTGSGSGMDFTFTISSVQAEDLAVYYCQQHYSTPLTFGAGTKLELER

SEQ ID NO: 9131 - protein, 108 aa, Artificial Sequence
  Description of Artificial Sequence: Synthetic polypeptide
DIQMTQSPASLAASVGETVTITCRASENIYTFLAWYQQKQGKSPQLLVYTTKTLAEGVPSRFSGSGSGTQFSLKIKSLQPEDFGSYYCQHHYGLPLTFGAGTKLELKR

SEQ ID NO: 9132 - protein, 107 aa, Artificial Sequence
  Description of Artificial Sequence: Synthetic polypeptide
DIVMTQSHKFMSTSVGDRVSITCKASQDVSTAVAWYQQKPGQSPKLLIYSASYRSTGVPDRFTGSGSGTDFTFTISSVQAEDLAVYYCQQHYSTPTFGAGTKLELKR

SEQ ID NO: 9133 - protein, 108 aa, Artificial Sequence
  Description of Artificial Sequence: Synthetic polypeptide
SIVMTQTPKFLLVSAGDRVTITCKASQSVSNDVAWFQQKPGQSPKLLIYYASNRYAGVPDRFTGSGFGTDFTFTISTVQAEDLAVYFCHQDYSSPRTFGGGTKLEIKR

SEQ ID NO: 9134 - protein, 112 aa, Artificial Sequence
  Description of Artificial Sequence: Synthetic polypeptide
DNVLTQSPPSLAVSLGQRATISCKANWPVDYNGDSYLNWYQQKPGQPPKFLIYAASNLESGIPARFSGSGSGTDFNLNIHPVEEEDAATYYCQQSNEDPFTFGSGTKLEIKR

SEQ ID NO: 9135 - protein, 113 aa, Artificial Sequence
  Description of Artificial Sequence: Synthetic polypeptide
DVVMTQTPLTLSVTTGQPASISCKSSQSLLDSDGKTYLNWLFQRPGESPKLLIYVVSKLESGVPDRFTGSGSGTDFTLKISRVEAEDLGVYYCLQATHFPWTFGGGTKLEIKR

SEQ ID NO: 9136 - protein, 113 aa, Artificial Sequence
  Description of Artificial Sequence: Synthetic polypeptide
DVVMTQTPLTLSVTTGQPASISCKSSQSLLDSDGKTYLNWLFQRPGESPKLLIYVTDILESGVPDRFTGSGSGTDFTLKISRVEAEDLGVYYCLQATHFPWTFGGGTKLEIKR

SEQ ID NO: 9137 - protein, 108 aa, Artificial Sequence
  Description of Artificial Sequence: Synthetic polypeptide
DILLTQSPVILSVSPGERVSFSCRTSKNVGTNIHWYQQRTNGSPRLLIKYASERLPGIPSRFSGSGSGTDFTLSINSVESEDIADYYCQQSNNWPYTFGGGTKLEIKR

SEQ ID NO: 9138 - protein, 156 aa, Artificial Sequence; identical to SEQ ID NO: 7423
  Description of Artificial Sequence: Synthetic polypeptide

SEQ ID NO: 9139 - protein, 112 aa, Artificial Sequence
  Description of Artificial Sequence: Synthetic polypeptide
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPLTFGAGTKLELK

SEQ ID NO: 9140 - protein, 107 aa, Artificial Sequence [sequence omitted]

SEQ ID NO: 9141 - protein, 108 aa, Artificial Sequence
  Description of Artificial Sequence: Synthetic polypeptide
DIQMTQSPSSLCASVGDRVTITCRASRSITRYLNWYQQKPGKAPKLLIYGASSLQSGVPSRFSGSGSGTDFTLTISSLQPEDFATYYCQQSYSTPPITFGQGTRLEIK

SEQ ID NO: 9142 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLIIYWTSTRESGVPDRFSGSGSGTDFTLTISSLQAEDVAVYYCQQYYSTPFTFGPGTKVDIK

SEQ ID NO: 9143 - protein, 106 aa, Artificial Sequence
  Description of Artificial Sequence: Synthetic polypeptide
EIVLTQSPATLSLSPGERATLSCRASQSVSTYLTWYQQKPGQAPRLLIYDASNRATGIPARFSGSGSGTDFTLTISSLEPEDCAVYYCQQRSIWITFGQGTRLEIK

SEQ ID NO: 9144 - protein, 107 aa, Artificial Sequence
  Description of Artificial Sequence: Synthetic polypeptide
DIQMTQSPSSLSASVGDRVTITCRTSQGIRVDLAWYQQKPGKAPERLIYAASSLQSGVPSRFSGGGSGTEFTLTVSSLQPEDFATYYCLQHHNFPYTFGQGTKLEIK

SEQ ID NO: 9145 - protein, 108 aa, Artificial Sequence
  Description of Artificial Sequence: Synthetic polypeptide
EIVLTQSPDTISLSPGERATLSCRASQSISSIYLAWYQQKPGQAPRLLIYGASSRVTGIPDRFSVSGSGTDFTLTISRLEPEDFAVYYCQHYGISPFTFGPGTKVDIR

SEQ ID NO: 9146 - protein, 107 aa, Artificial Sequence
  Description of Artificial Sequence: Synthetic polypeptide
DIQMTQSPSTLSASVGDRVTITCRASQSISDWLAWYQQKPGKAPKLLIFKASTLESGVPSRFSGSGSGTEFTLTISSLQPDDFATYYCQQYNSYSRTFGQGTKVEIK

SEQ ID NO: 9147 - protein, 107 aa, Artificial Sequence
  Description of Artificial Sequence: Synthetic polypeptide
DIQMTQSPSTLSASVGDRVIITCRASQNINNWLAWYQQQPGKAPKLLIYEASSLESGVPSRFSGSGSGTEFTLTIGSLQPDDFATYYCQHYNSYSRTFGQGTKVDIK

SEQ ID NO: 9148 - protein, 108 aa, Artificial Sequence
  Description of Artificial Sequence: Synthetic polypeptide
AIRMTQSPSTLSASVGDRVTITCRASQSISDWLAWYQQKPGKAPNLLIYKASSLESGVPSRFSGSGSGTEFTLTISGLQPDDFATYYCQQYNSYSRTFGQGTKLEIKR

SEQ ID NO: 9149 - protein, 107 aa, Artificial Sequence
  Description of Artificial Sequence: Synthetic polypeptide
AIRMTQSPSSLSASVGDRVTITCRASQDINSYLAWFQQKPGKAPKSLIYTASSLQSGVPSKFSGSGSGTDFTLTISSLQPEDFATYYCQQYNTYPYTFGQGTKVESK

SEQ ID NO: 9150 - protein, 107 aa, Artificial Sequence
  Description of Artificial Sequence: Synthetic polypeptide
DIQMTQSPSTLSASVGDRLTITCRASQSISTWLAWYQQKPGKAPTLLIYKASSLESGVPSRFSGSGSGTDFTLTISSLQPDDFATYYCQQYKTSWTFGQGTKLEIKR

SEQ ID NO: 9151 - protein, 113 aa, Artificial Sequence
  Description of Artificial Sequence: Synthetic polypeptide
AIQLTQSPDSLALSLGERATINCKSSQSVLYSSNNKNYLAWYQQKPGQPPKLLIYWASSRESGVPDRFSGSGSGTDFTLTISSLQAEDVAVYYCQQFYGTPYTFGQGTKVDIK

SEQ ID NO: 9152 - protein, 107 aa, Artificial Sequence
  Description of Artificial Sequence: Synthetic polypeptide
AIRMTQSPSSLSASVGDRVTITCRASQDISNYLAWFQQQPGKAPKSLIYATSSLNSGVPSKFSGSGSGTDFTLTISSLQPEDFATYYCQQYKSYPLTFGGGTKVEIK

SEQ ID NO: 9153 - protein, 113 aa, Artificial Sequence
  Description of Artificial Sequence: Synthetic polypeptide
DIVMTQSPESLAVSLGERATINCKSSQSILYSSNNKNYLAWYQLKPGQPPNLLIYWASTRESGVPDRFSGSGSGTDFTLTIGSLQAEDVAVYYCQQYYSTPFTFGPGTKVDIK

SEQ ID NO: 9154 - protein, 107 aa, Artificial Sequence
  Description of Artificial Sequence: Synthetic polypeptide
DIQMTQSPSTLSASVGDRVTITCRASQSISSWLSWYQQKPGKAPKLLIYMASTLESGVPSRFSGSGSGTDFTLTITSLQPDDFATYYCQQSNSYSRTFGHGTKLEIK

SEQ ID NO: 9155 - protein, 107 aa, Artificial Sequence
  Description of Artificial Sequence: Synthetic polypeptide
DIQLTQSPSTLSASVGDRVTITCRASQSFNNWLSWYQQKPGKAPKLLIYMASTLESGVPSRFSGSGSGTDFTLTINSLQPDDFATYYCQQSNSYSRTFGHGTKVEIK

SEQ ID NO: 9156 - protein, 107 aa, Artificial Sequence
  Description of Artificial Sequence: Synthetic polypeptide
DIQLTQSPSTLSASVGDRVTITCRASQSISDWLAWYQQKPGKAPNLLIYKASTLESGVPSRFSGSGSGTEFTLTISSLQPDDFATYYCQQYNSYSRTFGQGTKVEIK

SEQ ID NO: 9157 - protein, 107 aa, Artificial Sequence
  Description of Artificial Sequence: Synthetic polypeptide
AIQMTQSPSTLSASVGDIVTITCRASQSISDWLAWYQQKPGKAPKLLIFKASSLESGVPSRFSGSGSGTDFTLTISSLQPDDFATYYCQQYNSYSRTFGQGTKVDIK

SEQ ID NO: 9158 - protein, 112 aa, Artificial Sequence
  Description of Artificial Sequence: Synthetic polypeptide
DIQLTQSPDSLAVSLGERATINCKSSQSVLYRSNNKKFLVWYQQKPGQPPKPLIYWASTRESGVPDRFSGSGSGTDFTLTINSLQAEDVAVYYCQQYYSTPYTFGQGTKVEI

SEQ ID NO: 9159 - protein, 113 aa, Artificial Sequence
  Description of Artificial Sequence: Synthetic polypeptide
DIVMTQSPESLAVSLGERATINCKSSQNILYRSNNKNYLAWYQQKPGQPPKLLIYWASTRESGVPDRFSGSGSGTDFTLTISSLQAEDVAVYYCQQYYGTPYTFGQGTNLEIK

SEQ ID NO: 9160 - protein, 107 aa, Artificial Sequence
  Description of Artificial Sequence: Synthetic polypeptide
DIQMTQSPSSLSASVGDRVTITCRASQGIRNDLGWYQLKPGKAPKRLIFAASSLQSGVPSRFSGSGSGTEFTLTISSLQPEDFATYYCLQHNSYPWTFGQGTKVEIK

SEQ ID NO: 9161 - protein, 113 aa, Artificial Sequence
  Description of Artificial Sequence: Synthetic polypeptide
DIVMTQSPDSPAVSLGERATINCKSSQSVLYSSSNKNYLAWYQQKPGQPPRLLIYWASTRESGVPDRFSGSGSGTDFTLTISSLQAEDVAVYYCQQYYSGPYTFGQGTKLEIK

SEQ ID NO: 9162 - protein, 113 aa, Artificial Sequence
  Description of Artificial Sequence: Synthetic polypeptide
DIVMTQSPDSLAVSLGERATINCKSSQSVLYRSDNKNYLAWYQQRPGQPPKLLIYWASTRESGVPGRFSGSGSGTDFTLTISSLQGEDVAVYYCHQYYNIPFTFGPGTKVDIK

SEQ ID NO: 9163 - protein, 112 aa, Artificial Sequence
  Description of Artificial Sequence: Synthetic polypeptide
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEI

SEQ ID NO: 9164 - protein, 112 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEI

SEQ ID NO: 9165 - protein, 113 aa, Artificial Sequence
  Description of Artificial Sequence: Synthetic polypeptide
NIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 9166 - protein, 113 aa, Artificial Sequence
  Description of Artificial Sequence: Synthetic polypeptide
DIQLTQSPGSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 9167 - protein, 112 aa, Artificial Sequence
  Description of Artificial Sequence: Synthetic polypeptide
AIRMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEI

SEQ ID NO: 9168 - protein, 113 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIK

SEQ ID NO: 9169 - protein, 113 aa, Artificial Sequence
  Description of Artificial Sequence: Synthetic polypeptide
AIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEIK

SEQ ID NO: 9170 - protein, 113 aa, Artificial Sequence
  Description of Artificial Sequence: Synthetic polypeptide
AIQMTQSPDSLAVSLGERATINCKSSQSVLYSSNNKNYLAWYQQKPGQPPRLLIYWASTRESGVPARFSGSGSGTDFTLTISSLQAEDVAVYYCQQYYSTPFTFGQGTKLEIK

SEQ ID NO: 9171 - protein, 113 aa, Artificial Sequence
  Description of Artificial Sequence: Synthetic polypeptide
NIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLELR

SEQ ID NO: 9172 - protein, 113 aa, Artificial Sequence
  Description of Artificial Sequence: Synthetic polypeptide
AIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 9173 - protein, 113 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 9174 - protein, 113 aa, Artificial Sequence
  Description of Artificial Sequence: Synthetic polypeptide
DIQMTQSPDSLAVSLGERVTINCKSSQSVLYSSNNKNYLAWYQQKPGQPPKLLIYWASTRESGVPARFSGSGSGTDFTLTISSLQAEDVAVYYCQQYYSTPFTFGQGTKLEIM

SEQ ID NO: 9175 - protein, 113 aa, Artificial Sequence
  Description of Artificial Sequence: Synthetic polypeptide
AIQMTQSPDSLAVSLGERATINCKSSQSLLYSANNKNYLAWYQQKPGQPPKLLIYWASTRESGVPDRFSGSGSGTDFTLTISSLQAEDVAVYYCQQYYSTPWTFGQGTKVEIK

SEQ ID NO: 9176 - protein, 113 aa, Artificial Sequence; identical to SEQ ID NO: 9171
  Description of Artificial Sequence: Synthetic polypeptide

SEQ ID NO: 9177 - protein, 112 aa, Artificial Sequence
  Description of Artificial Sequence: Synthetic polypeptide
AIQMTQSPDSLAVSLGERATINCKSSQSVLYSPNKKNYLAWYQQKPGQPPKLLIYWASTRESGVPDRFSGSGSGTDFTLTISSLQAEDVAVYYCQQYYSTPYTFGQGTKLEI

SEQ ID NO: 9178 - protein, 113 aa, Artificial Sequence
  Description of Artificial Sequence: Synthetic polypeptide
EIVLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTRLEIK

SEQ ID NO: 9179 - protein, 113 aa, Artificial Sequence
  Description of Artificial Sequence: Synthetic polypeptide
AIWMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLELR

SEQ ID NO: 9180 - protein, 112 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEI

SEQ ID NO: 9181 - protein, 107 aa, Artificial Sequence
  Description of Artificial Sequence: Synthetic polypeptide
DIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGQGTKVEIK

SEQ ID NO: 9182 - protein, 107 aa, Artificial Sequence
  Description of Artificial Sequence: Synthetic polypeptide
DVVMTQSPSSLSASVGDRVTITCRASQSISSYLNWYQQKPGKAPKLLIYAASSLQSGVPSRFSGSGSGTDFTLTISSLQPEDFATYYCQQSYTTPYTFGQGTKLEIK

SEQ ID NO: 9183 - protein, 107 aa, Artificial Sequence
  Description of Artificial Sequence: Synthetic polypeptide
AIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 9184 - protein, 107 aa, Artificial Sequence
  Description of Artificial Sequence: Synthetic polypeptide
EIVLTQSPSSLSASVGDRVTITCRASQSISSYLNWYQQKPGKAPKLLIYAASTLQSGVPSRFSGSGSGTDFTLTISSLQPEDFATYYCQQSYSTPPTFGQGTKVEIK

SEQ ID NO: 9185 - protein, 107 aa, Artificial Sequence
  Description of Artificial Sequence: Synthetic polypeptide
DIQMTQSPLSLSASVGDRVTITCRASQSVGSYLNWYQQKPGKAPKLLIFAAYSLQTGVPSRFSGSGSETEFSLTISGLQPEDFATYYCQQLNFYPFTFGPGTTVDIK

SEQ ID NO: 9186 - protein, 107 aa, Artificial Sequence
  Description of Artificial Sequence: Synthetic polypeptide
DIVMTQSPSSLSASVGDRVTITCRASQSISSYLNWYQQKPGKAPNLLIYAASSLQSGVPSRFSGSGSGTDFTLTISSLQPEDFATYYCQQSYSTPLTFGQGTKVEIK

SEQ ID NO: 9187 - protein, 107 aa, Artificial Sequence
  Description of Artificial Sequence: Synthetic polypeptide
DIVMTQSPSSVSASVGDRVTITCRASQGISSYLNWYQQKPGKAPKLLIYAASSLQSGVPSRFSGSGSGTDFTLTISSLQPEDFATYYCQQSYSTPITFGGGTKVEIK

SEQ ID NO: 9188 - protein, 107 aa, Artificial Sequence
  Description of Artificial Sequence: Synthetic polypeptide
ETTLTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 9189 - protein, 107 aa, Artificial Sequence
  Description of Artificial Sequence: Synthetic polypeptide
EIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 9190 - protein, 107 aa, Artificial Sequence; identical to SEQ ID NO: 9183
  Description of Artificial Sequence: Synthetic polypeptide

SEQ ID NO: 9191 - protein, 107 aa, Artificial Sequence
  Description of Artificial Sequence: Synthetic polypeptide
AIQLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 9192 - protein, 107 aa, Artificial Sequence
  Description of Artificial Sequence: Synthetic polypeptide
DVVMTQSPLSPSASVGDRVAITCRASQSIDTYLNWYQQKPGTAPKLLIYAASSLQSGVPSRFSGSGSGTDFTLTISSLQPEDFATYYCQQSYSTPITFGQGTRLELR

SEQ ID NO: 9193 - protein, 107 aa, Artificial Sequence
  Description of Artificial Sequence: Synthetic polypeptide
AIWMTQSPSSLSASVGDRVTITCRASQSISSYLNWYQQKPGKAPKLLIYAASKLEDGVPSRFSGSGAGTDFTLTISRLEPEDFATYYCQQSYSTPLTFGGGTKVEIK

SEQ ID NO: 9194 - protein, 110 aa, Artificial Sequence
  Description of Artificial Sequence: Synthetic polypeptide
QPVLTQPPSASGTPGQRVTISCSGSSSNIGSNTVNWYQQLPGMPPKVLISGNNQRPPGVPGRFSGSKSGTSASLAISGLQSEDEADYHCTAWDDNLNGPVFGGGTQLTVL

SEQ ID NO: 9195 - protein, 107 aa, Artificial Sequence
  Description of Artificial Sequence: Synthetic polypeptide
AIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 9196 - protein, 112 aa, Artificial Sequence
  Description of Artificial Sequence: Synthetic polypeptide
AIQLTQSPDSLAVSLGERATINCKSSQSVLYSSNNKNYLAWYQQKPGQPPKLLIYRASTRESGVPDRFSGSGSGTDFTLTISSLQAEDVAVYYCQQYYSTPWTFGQGTKVEI

SEQ ID NO: 9197 - protein, 107 aa, Artificial Sequence
  Description of Artificial Sequence: Synthetic polypeptide
NIQMTQSPSSLSASVGDRVTITCRASQTISTYLNWYQQKPGKAPKLLIYGASSLQSGVPSRFSGSGSGTDFTLTISSLQPEDFATYYCQQSYSTPVTFGQGTKVEIK

SEQ ID NO: 9198 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 9199 - protein, 106 aa, Artificial Sequence
  Description of Artificial Sequence: Synthetic polypeptide
DIVMTQSPSSLSASVGDRVTITCRASQSISSYLNWYQQKPGKAPKLLIYAASNLQSGVPSRFSGSGSGTDFTLTISSLQREDFATYYCQQSYSAPTFGQGTKVEIK

SEQ ID NO: 9200 - protein, 110 aa, Artificial Sequence
  Description of Artificial Sequence: Synthetic polypeptide
QSVLTQPPSASGTPGQRVTISCSGSSSNIGSNPVNWYQQLPGTAPKLLIYSNRQRPSGVPDRFSGSRSGTSGSLAISGLQSEDEADYYCATWDDSLNGWVFGGGTQLTVL

SEQ ID NO: 9201 - protein, 107 aa, Artificial Sequence
  Description of Artificial Sequence: Synthetic polypeptide
DVVMTQSPLSLSASVGDRVTITCRASQTISRYLNWYQQKPGTAPKLLIYAASSLQSGVPSRFSGSGSGTDFTLTISSLQPEDFATYYCQQSYSTPPTFGQGTKVEIK

SEQ ID NO: 9202 - protein, 107 aa, Artificial Sequence
  Description of Artificial Sequence: Synthetic polypeptide
AIQMTQSPSSLSASVGDRVTITCRASQSISSYLNWYQQKPGKAPKLLIHAASNLQSGVPSRFSGSGSGTDFTLTISSLQPEDFATYYCQQSYSTPLTFGGGTKVEIK

SEQ ID NO: 9203 - protein, 110 aa, Artificial Sequence
  Description of Artificial Sequence: Synthetic polypeptide
QSELTQPPSASGTPGQRVTISCSGSSSNIGRNPVNWYQHLPGTAPKLLIYGDNQRPSGVPDRFSGSRSGTSASLAISGLQSEDEADYYCAAWDDSLNGVVFGGGTKLTVL

SEQ ID NO: 9204 - protein, 107 aa, Artificial Sequence
  Description of Artificial Sequence: Synthetic polypeptide
AIQMTQSPDSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 9205 - protein, 106 aa, Artificial Sequence
  Description of Artificial Sequence: Synthetic polypeptide
DIVMTQSPSSLSASVGDRVTITCRASQSISSYLNWYQQKPGKAPKLLIYAASSLQSGVPSRFSGSGSGTDFTLTISSLQPEDFATYYCQQSYSAPTFGQGTKVEIK

SEQ ID NO: 9206 - protein, 107 aa, Artificial Sequence
  Description of Artificial Sequence: Synthetic polypeptide
AIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLTVL

SEQ ID NO: 9207 - protein, 121 aa, Artificial Sequence; identical to SEQ ID NO: 6813
  Description of Artificial Sequence: Synthetic polypeptide

SEQ ID NO: 9208 - protein, 107 aa, Artificial Sequence
  Description of Artificial Sequence: Synthetic polypeptide
DIQLTQSPSSLSASLGDRVTITCRASESIRGYLNWYQQKPGKAPKLLIYAASSLQSGVPSRFSGSGSGTDFTLTISSLQPEDFATYFCQQSYSTPYTFGQGTKLEIK

SEQ ID NO: 9209 - protein, 107 aa, Artificial Sequence
  Description of Artificial Sequence: Synthetic polypeptide
AIQLTQSPSSVSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 9210 - protein, 107 aa, Artificial Sequence
  Description of Artificial Sequence: Synthetic polypeptide
DVVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 9211 - protein, 110 aa, Artificial Sequence
  Description of Artificial Sequence: Synthetic polypeptide
QSVLTQPPSASGTPGQRVTISCSGSSSNIGSNNVNWYQQLPGTAPKLLIYSNDQRPSGVPDRFSGSRSGTSGSLAISGLQSEDEADYYCATWDDSLNGWVFGGGTKLTVL

SEQ ID NO: 9212 - protein, 107 aa, Artificial Sequence
  Description of Artificial Sequence: Synthetic polypeptide
NIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 9213 - protein, 107 aa, Artificial Sequence
  Description of Artificial Sequence: Synthetic polypeptide
EIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGPGTKVDIK

SEQ ID NO: 9214 - protein, 110 aa, Artificial Sequence
  Description of Artificial Sequence: Synthetic polypeptide
QSVLTQPPSASETPGQRVTISCSGVSSNIGRNSVTWYQQLPGTAPKLLIYRNNQRPSGVPDRFSGSKSGTSASLAISGLRSEDEADYYCATWDDSLSGWVFGGGTKLTVL

SEQ ID NO: 9215 - protein, 107 aa, Artificial Sequence
  Description of Artificial Sequence: Synthetic polypeptide
AIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKLEIK

SEQ ID NO: 9216 - protein, 107 aa, Artificial Sequence
  Description of Artificial Sequence: Synthetic polypeptide
NIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 9217 - protein, 106 aa, Artificial Sequence
  Description of Artificial Sequence: Synthetic polypeptide
AIRMTQSPSSLSASVGDRVTITCRASQSISSYLNWYQQKPGKAPKLLIYAASSLQSGVPSRFSGSGSGTDFTLTISSLQPEDFATYYCQQSYSAPTFGQGTKVGIK

SEQ ID NO: 9218 - protein, 112 aa, Artificial Sequence; identical to SEQ ID NO: 9167
  Description of Artificial Sequence: Synthetic polypeptide

SEQ ID NO: 9219 - protein, 110 aa, Artificial Sequence
  Description of Artificial Sequence: Synthetic polypeptide
QSELTQPPSASGTPGQRVTISCSGSSSNIGSNPVNWYQQLPGTAPKLLIYSNRQRPSGVPDRFSGSRSGTSGSLAISGLQSEDEADYYCATWDDSLNGWVFGGGTQLTVL

SEQ ID NO: 9220 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 9221 - protein, 110 aa, Artificial Sequence
  Description of Artificial Sequence: Synthetic polypeptide
QSELTQPPSASGTPGQGVTISCSGSSSNIGSNTVQWYQQFPGRAPKLLIYSNNRRPSGVPDRFSGSKSGTSASLAISGLRSEDQADYYCAAWDDSLSVVVFGGGTKLTVL

SEQ ID NO: 9222 - protein, 107 aa, Artificial Sequence
  Description of Artificial Sequence: Synthetic polypeptide
AIWMTQSPSSLSASVGDRVTITCRTSQSISNYLNWYQQKPGKAPKLLIYARSSLQSGVPSRFSGSGSGTDFTLTISSLQPEDFATYYCQQSYSTPITFGQGTRLEIK

SEQ ID NO: 9223 - protein, 110 aa, Artificial Sequence
  Description of Artificial Sequence: Synthetic polypeptide
QSVLTQPPSASGTPGQRVTISCSGSSSNIGSNIVNWFQQLPGTAPKLLIYSDNQRPSGVPDRFSGSRSGTSGSLAISGLQSEDEADYYCATWDDSLNGWVFGGGTKLTVL

SEQ ID NO: 9224 - protein, 107 aa, Artificial Sequence
  Description of Artificial Sequence: Synthetic polypeptide
NIQMTQSPSSLSASVGDRVTITCRASQSISSYLNWYQQKPGKAPKLLIYDASSLQSGVPLRFSGSGSGTDFTLTISSLQPEDFATYYCQQSYSTPLTFGGGTKVDIK

SEQ ID NO: 9225 - protein, 107 aa, Artificial Sequence
  Description of Artificial Sequence: Synthetic polypeptide
AIQLTQSPSSLSASVGDRVTITCRASQSISSYLNWYQQKPGKAPKLLIYAASSLQSGVPSRFSGSGSGTDFTLTISSLQPEDFAAYYCQQSYTTPLTFGQGTKVEIK

SEQ ID NO: 9226 - protein, 107 aa, Artificial Sequence
  Description of Artificial Sequence: Synthetic polypeptide
AIWMTQSPSSLSASVGDRVTIPCRSSQNINNFVNWYQQKPGKAPKLLIYAASRLKGGVPSRFSGSGSGTDFTLTISSLQPEDFATYYCQQSYSTPLTFGGGTKLEIK

SEQ ID NO: 9227 - protein, 107 aa, Artificial Sequence
  Description of Artificial Sequence: Synthetic polypeptide
DVVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 9228 - protein, 110 aa, Artificial Sequence
  Description of Artificial Sequence: Synthetic polypeptide
QSVLTQPPSVSEAPRQRVTISCSGSSSNIGKNAVHWYQQLPGKAPRLLIYYDDLLPSGVSDRFSGSRSGTSASLAISGLRSEDEADYYCAAWDDSLSGWVFGGGTKLTVL

SEQ ID NO: 9229 - protein, 112 aa, Artificial Sequence; identical to SEQ ID NO: 9180
  Description of Artificial Sequence: Synthetic polypeptide

SEQ ID NO: 9230 - protein, 107 aa, Artificial Sequence
  Description of Artificial Sequence: Synthetic polypeptide
EIVLTQSPSSLSASVGDRVTITCRASQSISSYLNWYQQKPGKAPKLLIYAASSLQSGVPSRFSGSGSGTDFTLTISGLQPEDFATYYCQQSYSSPLTFGGGTKVEIK

SEQ ID NO: 9231 - protein, 107 aa, Artificial Sequence; identical to SEQ ID NO: 9189
  Description of Artificial Sequence: Synthetic polypeptide

SEQ ID NO: 9232 - protein, 107 aa, Artificial Sequence
  Description of Artificial Sequence: Synthetic polypeptide
DIVMTQTPLSLSASVGDRVTITCRASQSIDTYLNWYQQKPGKAPKLLIYAASSLQSGVPSRFSGSGSGTDFTLTISSLQPEDFATYYCQQSYSTPLTFGGGTKVDIK

SEQ ID NO: 9233 - protein, 116 aa, Artificial Sequence
  Description of Artificial Sequence: Synthetic polypeptide
QSVLTQPPSASGTPGQRVSISCSGSSSNIGANYVSWYQQLPGTAPRLLIYTNDQRPSGVPDRFSGSKSGTSASLAISGLRSEDEADYYCAAWDDSPTGDDSLSSYVFGTGTKVTVL

SEQ ID NO: 9234 - DNA, 364 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctctaagtacgatatgcattgggttcgccaagctcctggtaaaggtttggagtgggtttctgttatctctccttctggtggctggacttcttatgctgactccgttaaaggtcgcttcactatctctagagacaactctaagaatactctctacttgcagatgaacagcttaagggctgaggacaccgccatgtattactgtgcgagggatgactacagtaaaggacgggatgcttttgatatctggggccaagggaccacggtcaccgtctcaagcg

SEQ ID NO: 9235 - protein, 107 aa, Artificial Sequence
  Description of Artificial Sequence: Synthetic polypeptide
EIVLTQSPSSLSASVGDRVTITCRASQSISSYLNWYQQKPGKAPKLLIYAASSLQSGVPSRFSGSGSGTDFTLAISSLQPEDFATYYCQQSYSTPLTFGGGTKVEIK

SEQ ID NO: 9236 - protein, 107 aa, Artificial Sequence
  Description of Artificial Sequence: Synthetic polypeptide
EIVLTQSPSSLSASVGDRVAITCRASQSISSYLNWYQQKPGKAPKLLIYAASSLQSGVPSRFSGSGSGTDFTLTISSLQPEDFATYYCQQSYSTPYTFGQGTKVDIK

SEQ ID NO: 9237 - protein, 107 aa, Artificial Sequence
  Description of Artificial Sequence: Synthetic polypeptide
EIVLTQSPLSLSASVGDRVTITCRASQSISSYLNWYQQKPGKAPKLLIYAASSLQSGVPSRFSGSGSGTDFTLTISSLQPEDFATYYCQQSYSTPLTFGGGTKVDIK

SEQ ID NO: 9238 - protein, 107 aa, Artificial Sequence
  Description of Artificial Sequence: Synthetic polypeptide
NIQMTQSPSSLSASVGDRVTITCRASQSISSYLNWYQQKPGKAPELLIYAASSLQSGVPSRFSGSGSGTDFTLTISSLQPEDFATYYCQQSYSTPLTFGGGTKVEIK

SEQ ID NO: 9239 - DNA, 355 bp, Artificial Sequence
  Description of Artificial Sequence: Synthetic polynucleotide
gaagttcaattgttagagtctggtggcggtcttgttcagcctggtggttctttacgtctttcctgcgctgcttccggattcactttctctcattacgagatgggttgggttcgccaagctcctggtaaaggtttggagtgggtttcttatatctcttcttctggtggctggactacttatgctgactccgttaaaggtcgcttcactatctctagagacaactctaagaatactctctacttgcagatgaacagcttaagggctgaggacacggccgtgtattactgtgcaaggattgactacgcagatgcttttgatatctggggccaaggcaccctggtcactgtctcaagcg

SEQ ID NO: 9240 - protein, 112 aa, Artificial Sequence; identical to SEQ ID NO: 9164
  Description of Artificial Sequence: Synthetic polypeptide

SEQ ID NO: 9241 - protein, 107 aa, Artificial Sequence
  Description of Artificial Sequence: Synthetic polypeptide
EIVLTQSPSSLSASVGDRVAIACRASQSIDTYLNWYQQKPGKAPKLLIYAASSLQSGVPSRFSGSGSGTDFTLTISSLQPEDFATYYCQQSYSTPLTFGGGTKVEIK

SEQ ID NO: 9242 - protein, 107 aa, Artificial Sequence
  Description of Artificial Sequence: Synthetic polypeptide
EIVLTQSPSSLSASVGDRVTITCRASQSISSYLNWYQQKPGKAPKLLIYGASSLQSGVPSRFSGSGSGTDFTLTISSLQPEDFATYYCQQSYSTPLTFGGGTKVEIK

SEQ ID NO: 9243 - protein, 107 aa, Artificial Sequence
  Description of Artificial Sequence: Synthetic polypeptide
EIVMTQSPSSLSASVGDRVAITCRASQSIDTYLNWYQQKPGKAPKLLIYAASSLQSGVPSRFSGSGSGTDFTLTISSLQPEDFAIYYCQQSYSTPLTFGGGTKVEIK

SEQ ID NO: 9244 - protein, 107 aa, Artificial Sequence
  Description of Artificial Sequence: Synthetic polypeptide
DVVMTQSPLSLSASVGDRVAITCRASQSIDTYLNWYQQKPGKAPKPLIYAASSLRSGVPSRFSGSGSGTDFTLTISSLQPEDFATYYCQQSYSTSLTFGGGTKVDIK

SEQ ID NO: 9245 - protein, 107 aa, Artificial Sequence
  Description of Artificial Sequence: Synthetic polypeptide
EIVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGPGTKVEIK

SEQ ID NO: 9246 - protein, 107 aa, Artificial Sequence
  Description of Artificial Sequence: Synthetic polypeptide
EIVLTQSPLSLSASVGDRVTITCRASQSISTYLNWYQQKPGKAPRLLIYAASSLQSGVPSRFSGSGSGTDFTLTISSLQPEDFATYYCQQSYSTPITFGQGTRLEIK

SEQ ID NO: 9247 - protein, 107 aa, Artificial Sequence
  Description of Artificial Sequence: Synthetic polypeptide
DIQLTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTRLEIK

SEQ ID NO: 9248 - protein, 107 aa, Artificial Sequence
  Description of Artificial Sequence: Synthetic polypeptide
AIWMTQSPSSLSASVGDRVTITCRASQSISSYLNWYQQKPGKAPKLLIYAASSLQSGVPSRFSGSGSGTDFTLTISSLQPEDSATYYCQQSYSTPYTFGGGTKVEIK

SEQ ID NO: 9249 - protein, 107 aa, Artificial Sequence; identical to SEQ ID NO: 9227
  Description of Artificial Sequence: Synthetic polypeptide

SEQ ID NO: 9250 - protein, 107 aa, Artificial Sequence
  Description of Artificial Sequence: Synthetic polypeptide
AIWMTQSPSSLSASVGDRVTITCRASQSISSYLNWYQQKPGKAPKLLIYAASSLQSGVPSRFSGGGSGTDFTLTISSLQPEDFATYYCQQSYSTPLTFGGGTRLEIK

SEQ ID NO: 9251 - protein, 113 aa, Artificial Sequence
  Description of Artificial Sequence: Synthetic polypeptide
AIWMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 9252 - protein, 107 aa, Artificial Sequence; identical to SEQ ID NO: 9189
  Description of Artificial Sequence: Synthetic polypeptide

SEQ ID NO: 9253 - protein, 107 aa, Artificial Sequence
  Description of Artificial Sequence: Synthetic polypeptide
EIVLTQSPSSVSASVGDRVTITCRASQSISTYLNWYRQKPGKAPNLLISTASNLQSGVPSRFSGSGSGTDFTLTISSLQPEDFATYSCQQSYSTPFTFGPGTKVDIK

SEQ ID NO: 9254 - protein, 107 aa, Artificial Sequence
  Description of Artificial Sequence: Synthetic polypeptide
DVVMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTRLEIK

SEQ ID NO: 9255 - protein, 112 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEI

SEQ ID NO: 9256 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSIPWTFGQGTKVEIK

SEQ ID NO: 9257 - protein, 113 aa, Artificial Sequence
  Description of Artificial Sequence: Synthetic polypeptide
NIQMTQSPDSLAVSLGERVTINCKSSQSVLYSSNNKNYLAWYQQKPGQPPKLLIYWASTRESGVPARFSGSGSGTDFTLTISSLQAEDVAVYYCQQYYSTPFTFGQGTKVEIK

SEQ ID NO: 9258 - protein, 112 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKLEI

SEQ ID NO: 9259 - protein, 112 aa, Artificial Sequence; identical to SEQ ID NO: 9163
  Description of Artificial Sequence: Synthetic polypeptide

SEQ ID NO: 9260 - protein, 112 aa, Artificial Sequence
  Description of Artificial Sequence: Synthetic polypeptide
AIQMTQSPDSLAVSLGERATINCKSSQSVLYSSNNKNYLAWYQQKPGQSPKLLIYWASTRESGVPDRFSGSGSGTDFTLTISSLQAEDVAVYYCQQYYSTPITFGQGTRLEL

SEQ ID NO: 9261 - protein, 112 aa, Artificial Sequence; identical to SEQ ID NO: 9196
  Description of Artificial Sequence: Synthetic polypeptide

SEQ ID NO: 9262 - protein, 112 aa, Artificial Sequence
  Description of Artificial Sequence: Synthetic polypeptide
EIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEI

SEQ ID NO: 9263 - protein, 112 aa, Artificial Sequence; identical to SEQ ID NO: 9163
  Description of Artificial Sequence: Synthetic polypeptide

SEQ ID NO: 9264 - protein, 112 aa, Artificial Sequence; identical to SEQ ID NO: 9164
  Description of Artificial Sequence: Synthetic polypeptide

SEQ ID NO: 9265 - protein, 113 aa, Artificial Sequence
  Description of Artificial Sequence: Synthetic polypeptide
NIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIK

SEQ ID NO: 9266 - protein, 112 aa, Artificial Sequence
  Description of Artificial Sequence: Synthetic polypeptide
DIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEI

SEQ ID NO: 9267 - protein, 112 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEI

SEQ ID NO: 9268 - protein, 112 aa, Artificial Sequence; identical to SEQ ID NO: 9266
  Description of Artificial Sequence: Synthetic polypeptide

SEQ ID NO: 9269 - protein, 112 aa, Artificial Sequence
  Description of Artificial Sequence: Synthetic polypeptide
AIQMTQSPDSLAVSLGERATINCKSSQSVLYSSNNKNYLAWYQQKPGQPPKLLIYWASTRESGVPDRFSGTGSGTDFTLTISSLQAEDVAVYYCQQYYSTPFTFGQGTRLEL

SEQ ID NO: 9270 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 9271 - protein, 108 aa, Artificial Sequence
  Description of Artificial Sequence: Synthetic polypeptide
DIQLTQSPSSLSASVGDRVTISCRASQDISNYLNWYQQKPGKAPKLLIYYTSILHSGVPSRFSGSGSGTDYTFTISSLQPEDIATYYCQQGNTLPWTFGGGTKVQIKR

SEQ ID NO: 9272 - protein, 108 aa, Artificial Sequence
  Description of Artificial Sequence: Synthetic polypeptide
QIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELK

SEQ ID NO: 9273 - protein, 107 aa, Artificial Sequence
  Description of Artificial Sequence: Synthetic polypeptide
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIK

SEQ ID NO: 9274 - protein, 219 aa, Artificial Sequence
  Description of Artificial Sequence: Synthetic polypeptide
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 9275 - protein, 111 aa, Artificial Sequence
  Description of Artificial Sequence: Synthetic polypeptide
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIK

SEQ ID NO: 9276 - protein, 111 aa, Artificial Sequence
  Description of Artificial Sequence: Synthetic polypeptide
DIVLTQSPASLAVSLGQRATISCRASESVEYYGTSLMQWYQQKPGQPPKLLIYAASNVESGVPARFSGSGSGTDFSLNIHPVEEDDIAIYFCQQSRKDPSTFGGGTKLEIK

SEQ ID NO: 9277 - protein, 111 aa, Artificial Sequence
  Description of Artificial Sequence: Synthetic polypeptide
DIVLTQSPDSLAVSLGERATINCRASESVEYYGTSLMQWYQQKPGQPPKLLIYAASNVESGVPDRFSGSGSGTDFTLTISSLQAEDVAVYYCQQSRKDPSTFGGGTKVEIK

SEQ ID NO: 9278 - protein, 111 aa, Artificial Sequence
  Description of Artificial Sequence: Synthetic polypeptide
DIVLTQSPDSLAVSLGERATINCRASESVEYYGTSLMQWYQQKPGQPPKLLIYAASNVESGVPDRFSGSGSGTDFTLTISSLQAEDVAVYFCQQSRKDPSTFGGGTKVEIK

SEQ ID NO: 9279 - protein, 111 aa, Artificial Sequence
  Description of Artificial Sequence: Synthetic polypeptide
EIVLTQSPATLSLSPGERATLSCRASESVEYYGTSLMQWYQQKPGQAPRLLIYAASNVESGIPARFSGSGSGTDFTLTISSLEPEDIAVYFCQQSRKDPSTFGGGTKVEIK

SEQ ID NO: 9280 - protein, 111 aa, Artificial Sequence; identical to SEQ ID NO: 9275
  Description of Artificial Sequence: Synthetic polypeptide

SEQ ID NO: 9281 - protein, 111 aa, Artificial Sequence; identical to SEQ ID NO: 9277
  Description of Artificial Sequence: Synthetic polypeptide

SEQ ID NO: 9282 - protein, 111 aa, Artificial Sequence
  Description of Artificial Sequence: Synthetic polypeptide
AIRLTQSPSSFSASTGDRVTITCRASESVEYYGTSLMQWYQQKPGKAPKLLIYAASNVESGVPSRFSGSGSGTDFTLTISSLQSEDFATYYCQQSRKDPSTFGGGTKVEIK

SEQ ID NO: 9283 - protein, 127 aa, Artificial Sequence
  Description of Artificial Sequence: Synthetic polypeptide
MSVLTQVLALLLLWLTGARCDIQMTQSPASLSASVGETVTITCRASGNIHNYLAWYQQKQGKSPQLLVYNAKTLADGVPSRFSGSESGTQYSLKINSLQPEDFGSYYCQHFWSTPFTFGSGTKLELK

SEQ ID NO: 9284 - protein, 107 aa, Artificial Sequence
  Description of Artificial Sequence: Synthetic polypeptide
DIQMTQSPSSLSASVGDRVTITCRASGNIHNYLAWYQQKPGKAPKLLIYNAKTLADGVPSRFSGSGSGTDFTLTISSLQPEDFATYYCQHFWSTPFTFGQGTKLEIK

SEQ ID NO: 9285 - protein, 107 aa, Artificial Sequence
  Description of Artificial Sequence: Synthetic polypeptide
DIQMTQSPSSLSASVGDRVTITCRASGNIHNYLAWYQQKPGKAPKRLIYNAKTLADGVPSRFSGSGSGTEFTLTISSLQPEDFATYYCQHFWSTPFTFGQGTKLEIK

SEQ ID NO: 9286 - protein, 107 aa, Artificial Sequence
  Description of Artificial Sequence: Synthetic polypeptide
DIQMTQSPSSLSASVGDRVTITCRASGNIHNYLAWYQQKPGKVPKLLIYNAKTLADGVPSRFSGSGSGTDFTLTISSLQPEDVATYYCQHFWSTPFTFGGGTKVEIK

SEQ ID NO: 9287 - protein, 107 aa, Artificial Sequence
  Description of Artificial Sequence: Synthetic polypeptide
DIQMTQSPSSLSASVGDRVTITCRASGNIHNYLAWFQQKPGKAPKSLIYNAKTLADGVPSRFSGSGSGTDFTLTISSLQPEDFATYYCQHFWSTPFTFGQGTKLEIK

SEQ ID NO: 9288 - protein, 214 aa, Artificial Sequence
  Description of Artificial Sequence: Synthetic polypeptide
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9289 - protein, 107 aa, Artificial Sequence
  Description of Artificial Sequence: Synthetic polypeptide
DILLTQSPAILSVSPGERVSFSCRASQFVGSSIHWYQQRTNGSPRLLIKYASESMSGIPSRFSGSGSGTDFTLSINTVESEDIADYYCQQSHSWPFTFGSGTNLEVK

SEQ ID NO: 9290 - protein, 108 aa, Artificial Sequence
  Description of Artificial Sequence: Synthetic polypeptide
DIVMTQSHKFMSTTVGDRVSITCKASQAVSSAVAWYQQKPGQSPKLLIYWASTRHTGVPDRFTGSGSVTDFTLTIHNLQAEDLALYYCQQHYSTPFTFGSGTKLEIKR

SEQ ID NO: 9291 - protein, 107 aa, Artificial Sequence
  Description of Artificial Sequence: Synthetic polypeptide
DIQMTQSPSSLSASVGDRVTITCKASQAVSSAVAWYQQKPGKAPKLLIYWASTRHTGVPSRFSGSGSGTDFTLTISSLQPEDFATYYCQQHYSTPFTFGQGTKLEIK

SEQ ID NO: 9292 - protein, 107 aa, Artificial Sequence
  Description of Artificial Sequence: Synthetic polypeptide
EIVMTQSPATLSVSPGERATLSCKASQAVSSAVAWYQQKPGQAPRLLIYWASTRHTGIPARFSGSGSGTEFTLTISSLQSEDFAVYYCQQHYSTPFTFGQGTKLEIK

SEQ ID NO: 9293 - protein, 107 aa, Artificial Sequence
  Description of Artificial Sequence: Synthetic polypeptide
DIQMTQSPSSLSASVGDRVTITCKASQAVSSAVAWYQQKPGKSPKLLIYWASTRHTGVPSRFSGSGSGTDFTLTISSLQPEDFATYYCQQHYSTPFTFGQGTKLEIK

SEQ ID NO: 9294 - protein, 107 aa, Artificial Sequence; identical to SEQ ID NO: 9293
  Description of Artificial Sequence: Synthetic polypeptide

SEQ ID NO: 9295 - protein, 107 aa, Artificial Sequence; identical to SEQ ID NO: 9293
  Description of Artificial Sequence: Synthetic polypeptide

SEQ ID NO: 9296 - protein, 111 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLQPDDFATYYCQQGWSDSYVDNLFGQGTKLTVLG

SEQ ID NO: 9297 - protein, 111 aa, Artificial Sequence
  Description of Artificial Sequence: Synthetic polypeptide
EIVMTQSPSTLSASVGDRVIIKCQASQSISDWLAWYQQKPGKAPKLLIYGASRLASGFPSRFSGSGSGAEFTLTISGLEPADFATYYCQQGWSDSYVDNLFGQGTKLTVLG

SEQ ID NO: 9298 - protein, 111 aa, Artificial Sequence
  Description of Artificial Sequence: Synthetic polypeptide
EIVMTQSPSTLSASVGDRVIIKCQASQSISDWLAWYQQKPGKAPKLLIYGASRLASGVPSRFSGSGSGAEFTLTISSLQPDDFATYYCQQGWSDSYVDNLFGQGTKLTVLG

SEQ ID NO: 9299 - protein, 111 aa, Artificial Sequence
  Description of Artificial Sequence: Synthetic polypeptide
EIVMTQSPSTLSASVGDRVIITCQASQSISDWLAWYQQKPGKAPKLLIYGASRLASGFPSRFSGSGSGAEFTLTISSLQPDDFATYYCQQGWSDSYVDNLFGQGTKLTVLG

SEQ ID NO: 9300 - protein, 111 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLEPDDFATYYCQQGWSDSYVDNLFGQGTKLTVLG

SEQ ID NO: 9301 - protein, 111 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLQPADFATYYCQQGWSDSYVDNLFGQGTKLTVLG

SEQ ID NO: 9302 - protein, 115 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGAEFTLTISSLQPDDFATYYCAGYYRSGSGTANGSFGQGTKLTVLG

SEQ ID NO: 9303 - protein, 115 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGTEFTLTISSLQPDDFATYYCAGYYRSGSGTANGSFGQGTKLTVLG

SEQ ID NO: 9304 - protein, 111 aa, Artificial Sequence
  Description of Artificial Sequence: Synthetic polypeptide
EIVMTQSPSTLSASVGDRVIITCQASESIYSGLAWYQQKPGKAPKLLIYQASTLASGVPSRFSGSGSGAEFTLTISSLQPDDFATYYCQQGFGTSNVENPFGQGTKLTVLG

SEQ ID NO: 9305 - protein, 111 aa, Artificial Sequence
  Description of Artificial Sequence: Synthetic polypeptide
EIVMTQSPSTLSASVGDRVIITCQASESIYSGLAWYQQKPGKAPKLLIYQASTLASGVPSRFSGSGSGTDFTLAISSLQPDDFATYYCQQGFGTSNVENPFGQGTKLTVLG

SEQ ID NO: 9306 - protein, 111 aa, Artificial Sequence
  Description of Artificial Sequence: Synthetic polypeptide
EIVMTQSPSTLSASVGDRVIITCQASENIYTSLAWYQQKPGKAPKLLIYSASTLASGVPSRFSGSGSGAEFTLTISSLQPDDFATYYCQQGFATSNVENPFGQGTKLTVLG

SEQ ID NO: 9307 - protein, 111 aa, Artificial Sequence
  Description of Artificial Sequence: Synthetic polypeptide
EIVMTQSPSTLSASVGDRVIITCQASENIYTSLAWYQQKPGKAPKLLIYSASTLASGVPSRFSGSGSGTEFTLTISSLQPDDFATYYCQQGFATSNVENPFGQGTKLTVLG

SEQ ID NO: 9308 - protein, 112 aa, Artificial Sequence
  Description of Artificial Sequence: Synthetic polypeptide
EIVMTQSPSTLSASVGDRVIITCQASDNIYRGLAWYQQKPGKAPKLLIYDASTLQSGVPSRFSGSGSGTQFTLTISSLQPDDFATYYCLGVYGYSSDDGAAFGQGTKLTVLG

SEQ ID NO: 9309 - protein, 112 aa, Artificial Sequence
  Description of Artificial Sequence: Synthetic polypeptide
EIVMTQSPSTLSASVGDRVIITCQASDNIYRGLAWYQQKPGKAPKLLIYDASTLQSGVPSRFSGSGSGAEFTLTISSLQPDDFATYYCLGVYGYSSDDGAAFGQGTKLTVLG

SEQ ID NO: 9310 - protein, 112 aa, Artificial Sequence
  Description of Artificial Sequence: Synthetic polypeptide
EIVMTQSPSTLSASVGDRVIITCQSSQSVYGNIWMAWYQQKPGKAPKLLIYQASKLASGVPSRFSGSGSGAEFTLTISSLQPDDFATYYCQGNFNTGDRYAFGQGTKLTVLG

SEQ ID NO: 9311 - protein, 112 aa, Artificial Sequence
  Description of Artificial Sequence: Synthetic polypeptide
EIVMTQSPSTLSASLGDRVIITCQSSQSVYGNIWMAWYQQKSGKAPKLLIYQASKLASGVPSRFSGSGSGAEFSLTISSLQPDDFATYYCQGNFNTGDRYAFGQGTKLTVLG

SEQ ID NO: 9312 - protein, 111 aa, Artificial Sequence
  Description of Artificial Sequence: Synthetic polypeptide
EIVMTQSPSTLSASVGDRVIITCQASQSISNLLAWYQQKPGKAPKLLIYAASKLASGVPSRFSGSGSGAEFTLTISSLQPDDFATYYCQQGWSHTNVDNTFGQGTKLTVLG

SEQ ID NO: 9313 - protein, 111 aa, Artificial Sequence
  Description of Artificial Sequence: Synthetic polypeptide
EIVMTQSPSTLSASVGDRVIITCQASQSISNLLAWYQQKPGKAPKLLIVAASKLASGVPSRFSGSGSGTEFTLTISSLQPDDFATYYCQQGWSHTNVDNTFGQGTKLTVLG

SEQ ID NO: 9314 - protein, 115 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGAEFTLTISSLQPDDFATYYCAGYYRSGFGTANGSFGQGTKLTVLG

SEQ ID NO: 9315 - protein, 115 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGTEFTLTISSLQPDDFATYYCAGYYRSGFGTANGSFGQGTKLTVLG

SEQ ID NO: 9316 - protein, 125 aa, Artificial Sequence
  Description of Artificial Sequence: Synthetic polypeptide
MDTRAPTQLLGLLLLWLPGARCADIVMTQTPSSVSEPVGGTVTIMCQASQNIYSYLSWYQQKPGQPPKLLEYKASTLASGVPSRFAGSGSGTDFILTISDLECADAATYYCQSNYGSNSDSFGNA

SEQ ID NO: 9317 - protein, 122 aa, Artificial Sequence
  Description of Artificial Sequence: Synthetic polypeptide
MDTRAPTQLLGLLLLWLPGATFAQVLTQTPSSVSAAVGGTVTVSCQSSQNVYNNNDFVWFQQKPGQPPKRLIYWASTLASGVPSRFKGSGSGTQFTLTINDLECDDAATYYCAGAYITELRT

SEQ ID NO: 9318 - protein, 122 aa, Artificial Sequence
  Description of Artificial Sequence: Synthetic polypeptide
MDTRAPTQLLGLLLLWLPGATFAQVLTQTASSVSAAVGGTVTISCQSSQSVYNNNDFIWFQQKPGQPPKRLIYWASTLASGVSSRFKGSGSGTQFTLTINDLECDDAAVYYCAGAYDSEVRA

SEQ ID NO: 9319 - protein, 122 aa, Artificial Sequence
  Description of Artificial Sequence: Synthetic polypeptide
MDTRAPTQLLGLLLLWLPGATFAQVMTQTPASVSAAVGGTVTISCQSSESVYNNNDLIWFRQKPGQPPKRLIYWASQLASGVSSRFKGSGSGTQFTLTINDLECDDAATYYCAGAYDSEIRA

SEQ ID NO: 9320 - protein, 124 aa, Artificial Sequence
  Description of Artificial Sequence: Synthetic polypeptide
MDTRAPTQLLGLLLLWLPGARCALVMTQTPSPVSAAVGGTVTISCQSSESVVFNNRLSWYQQKPGQPPKLLIYWASTLASGVPSRFKGSGSGTQFTLTISGVECDDAATYYCAGYKSYSNDDFA

SEQ ID NO: 9321 - protein, 125 aa, Artificial Sequence
  Description of Artificial Sequence: Synthetic polypeptide
MDTRAPTQLLGLLLLWLPGARCADIVMTQTPSSVSEPVRGTVTIKCQASQNIYSYLSWYQQSPGQPPKLLIYKASTLASGVPSRFKGSGSGTDFTLTISDLECADAATYYCQSNYGSDSDSFGNA

SEQ ID NO: 9322 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQNIYSTLAWYQQKPGQPPKLLIYLASTLASGVPSRFKGSGSGTQFTLTISDLECADAATYYCQTSHGSNSDSFGYA

SEQ ID NO: 9323 - protein, 125 aa, Artificial Sequence
  Description of Artificial Sequence: Synthetic polypeptide
MDTRAPTQLLGLLLLWLPGARCADIVMTQTPASVEAAVGGTVTIKCQASQNIRSWLAWYQQKPGQPPKLLIYGASTLASGVPSRFQGSGSGTEYTLTIIDLDCADAATYYCQSNYGSNDNSYGNG

SEQ ID NO: 9324 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQNIYSTLAWYQQKPGQPPKLLIYLASTLASGVPSRFKGSGSGTQFTLTISDLECADAATYYCQTNHGSNSDSFGYA

SEQ ID NO: 9325 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQSIYSSFSWYQQIPGQRPKLLIYYASTLASGVPSRFSGSGSGTDFTLTISDLECADAATYYCQSNHGSNGDSFGNA

SEQ ID NO: 9326 - protein, 126 aa, Artificial Sequence
  Description of Artificial Sequence: Synthetic polypeptide
MDTRAPTQLLGLLLLWLPGARCADIVMTQTPASVSEPVGGTVTIKCQASQTIYSSLSVVYQQKPGQRPKLLIYAASTLASGVPSRFKGSGSGTDFTLTISDLECADAATYYCQSNHGSNSDSYGNA

SEQ ID NO: 9327 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQSIYSTLAWYQQKPGQPPKLLISLASTLASGVPSRFKGSGSGTQFTLTISDLECADAATYYCQTNHGSNSDSFGYA

SEQ ID NO: 9328 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQNIYSTLAWYQQKPGQPPKLLIYLASTLESGVPSRFKGSGSGTEFTLTISDLECADAATYYCQTSHGSNSESFGYA

SEQ ID NO: 9329 - protein, 125 aa, Artificial Sequence
  Description of Artificial Sequence: Synthetic polypeptide
MDTRAPTQLLGLLLLWLPGARCADIVMTQTPSSVSEPVRGTVTIKCQASQNIYSYLSWYRQSPGQPPNLLIYKASTLASGVPSRFKGSGSGTDFTLTISDLECADAATYYCQSNYGSNSDSFGNA

SEQ ID NO: 9330 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQNIYTTLAWYQQKPGQPPKLLIYLASTLASGVPSRFKGSGSETQFTLTISDLECADAATYYCQTSHGSNSDSFGYV

SEQ ID NO: 9331 - protein, 125 aa, Artificial Sequence
  Description of Artificial Sequence: Synthetic polypeptide
MDTRAPTQLLGLLLLWLPGARCADIVMTQTPSSVSAAVGGTVTIKCQASQSIDTYLAWYQQKPGQRPKLLIYGASNLASGVSSRFKGSGSGTEFALTISDLECADAATYYCQSNYGSNSDSFGNG

SEQ ID NO: 9332 - protein, 125 aa, Artificial Sequence
  Description of Artificial Sequence: Synthetic polypeptide
MDTRAPTQLLGLLLLWLPGARCADIVMTQTPASVSGPVGGTVTIKCQASQNIYSSFSWYQQIPGQRPKLLIYYASTLASGVPSRFSGSGSGTDFTLTISDLECADAATYYCQSNHGSNGDSFGNA

SEQ ID NO: 9333 - protein, 122 aa, Artificial Sequence
  Description of Artificial Sequence: Synthetic polypeptide
MDTRAPTQLLGLLLLWLPGSTFAIKVTQTPASVSAAVGGTVSINCQASEDIESYLAWYQQKPGQPPKLLLYDASALASGVPSRFKGSGSGTEYTLTISGVECADAATYYCQQGYSYSNVDNS

SEQ ID NO: 9334 - protein, 125 aa, Artificial Sequence
  Description of Artificial Sequence: Synthetic polypeptide
MDTRAPTQLLGLLLLWLPGARCADIVMTQTPASVSEPVGGTVTIKCQASQSIYRYLSWYHHKPGQPPKLLIYGASNLESGVPSRFKGSGSGTEYTLTISDLECDDAATYYCQSNYGANSDSYGDA

SEQ ID NO: 9335 - protein, 125 aa, Artificial Sequence
  Description of Artificial Sequence: Synthetic polypeptide
MDTRAPTQLLGLLLLWLPGARCADIVMTQTPSSVSAAVGGTVTINCQASQNIYSSLAWYQQKPGQPPKLLIFGASNLESGVPSRFKGSGSGTEFTLTISDLECADAAAYYCQSHHGSNSDSYGNA

SEQ ID NO: 9336 - protein, 125 aa, Artificial Sequence
  Description of Artificial Sequence: Synthetic polypeptide
MDTRAPTQLLGLLLLWLPGARCADIVMTQTPSSVSVPVGGTVTIKCQASQNIYSSLAWYQQKPGQPPKRLIYYAATLASGVPSRFKGSGSGTDFTLTISDLECADAATYYCQSNHGSNSDSYGNP

SEQ ID NO: 9337 - protein, 124 aa, Artificial Sequence
  Description of Artificial Sequence: Synthetic polypeptide
MDTRAPTQLLGLLLLWLPGARCADVVMTQTPSSVSEPVGGTVTIKCQASETIGNYLSWYQQKPGQPPKRLIYYASTLSSGVPSRFKGSGSGTDFTLTISDLECADAATYYCQKNYGSGASSLGA

SEQ ID NO: 9338 - protein, 123 aa, Artificial Sequence
  Description of Artificial Sequence: Synthetic polypeptide
MDTRAPTQLLGLLLLWLTGATFAAVLTQTPSPVSAVVGGTVSISCQSSKRVVNSVALSWYQQKPGRSPKLLIYFASKLASGVPSRFKGSGSGTQFTLAISDVQCDDAATYYCAGHYTDSGDDA

SEQ ID NO: 9339 - protein, 122 aa, Artificial Sequence
  Description of Artificial Sequence: Synthetic polypeptide
MDTRAPTQLLGLLLLWLPGATLAQVVTQTPASVSAAVGGTVTISCQSSQNVYNNNDLVWFQQKPGQPPKRLVYWASTLASGVSSRFRGSGSGTQFILTISDLQCDDAATYYCAGAYDSEIRA

SEQ ID NO: 9340 - protein, 122 aa, Artificial Sequence
  Description of Artificial Sequence: Synthetic polypeptide
MDTRAPTQLLGLLLLWLPDARCAYDMTQTPASVEVAGGGTVTIKCQASQSIANRLAWYQQKPGQPPKLLIYYASTLASGVPSRFSGSGSGTEFTLTISGVQCDDAATYYCQQTYSDNNVDNA

SEQ ID NO: 9341 - protein, 125 aa, Artificial Sequence
  Description of Artificial Sequence: Synthetic polypeptide
MDTRAPTQLLGLLLLWLPGARCADIVMTQTPASVEAAVGGTVTINCQASQSIVSWLAWYQQKPGQPPKLLIYGASTLASGVPSRFKGSGSGTEYTLTISDLECADAATYYCQSNYGSNSHSFGNT

SEQ ID NO: 9342 - protein, 110 aa, Artificial Sequence
  Description of Artificial Sequence: Synthetic polypeptide
AYQMTQSPSSLSASVGDRVTIKCQASESIYSSLAWYQQKPGKPPKLLIYSASTLASGVPSRFSGSGSGTDFTLTISSLQPEDFATYYCQQGFGTSNVENPFGGGTKVEIK

SEQ ID NO: 9343 - protein, 108 aa, Artificial Sequence
  Description of Artificial Sequence: Synthetic polypeptide
EIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIK

SEQ ID NO: 9344 - protein, 111 aa, Artificial Sequence; identical to SEQ ID NO: 8379
  Description of Artificial Sequence: Synthetic polypeptide

SEQ ID NO: 9345 - protein, 107 aa, Artificial Sequence; identical to SEQ ID NO: 9291
  Description of Artificial Sequence: Synthetic polypeptide

SEQ ID NO: 9346 - protein, 107 aa, Artificial Sequence; identical to SEQ ID NO: 9292
  Description of Artificial Sequence: Synthetic polypeptide

SEQ ID NO: 9347 - protein, 107 aa, Artificial Sequence; identical to SEQ ID NO: 9293
  Description of Artificial Sequence: Synthetic polypeptide

SEQ ID NO: 9348 - protein, 107 aa, Artificial Sequence
  Description of Artificial Sequence: Synthetic polypeptide
EIVMTQSPATLSLSPGERATLSCKASQAVSSAVAWYQQKPGQAPRLLIYWASTRHTGIPARFSGSGSGTDFTLTISSLQPEDFAVYYCQQHYSTPFTFGQGTKLEIK

SEQ ID NO: 9349 - protein, 107 aa, Artificial Sequence
  Description of Artificial Sequence: Synthetic polypeptide
EIVMTQSPATLSLSPGERATLSCKASQAVSSAVAWYQQKPGQSPRLLIYWASTRHTGVPARFSGSGSGTDFTLTISSLQPEDFAVYYCQQHYSTPFTFGQGTKLEIK

SEQ ID NO: 9350 - protein, 111 aa, Artificial Sequence
  Description of Artificial Sequence: Synthetic polypeptide
QAVVTQEPSLTVSPGGTVTLTCASSTGAVTSGNYPNWFQQRPGQPPRALIYSTSNKHSWTPARFSGSLLGGKAALTLSGAQPEDEAEYYCRLSYDLARPVFGGGTKLTVLG

SEQ ID NO: 9351 - protein, 112 aa, Artificial Sequence
  Description of Artificial Sequence: Synthetic polypeptide
QPVLTQSSSASASLGASVKLTCSLSSGHSSYAIAWHQQQPEKGPRYLMKLNSDGSHSKGDGIPDRFSGSSSGAERYLTISSLQSEDEADYYCQTWGSGIQVFGGGTKLTVLG

SEQ ID NO: 9352 - protein, 113 aa, Artificial Sequence
  Description of Artificial Sequence: Synthetic polypeptide
DVVMTQSPLSLPVTPGEPASISCRSSQSLLQSNGHNYLNWYLQKPGQSPQVLIYLASNRASGVPDRFSGSGSGTDFTLKISRVEAEDVGIYYCMQGLQIPLTFGGGTKVEIKR

SEQ ID NO: 9353 - protein, 117 aa, Artificial Sequence
  Description of Artificial Sequence: Synthetic polypeptide
QAVLTQPPSSSASPGESARLTCTLPSDINVRYYNIYWYQQKPGSPPRYLLYYQSDSHKGRGSGVPSRFSGSKDTSANTGILLISGLQSEDEADYYCMIWASNGSGVLGGGTQLTVLG

SEQ ID NO: 9354 - protein, 112 aa, Artificial Sequence
  Description of Artificial Sequence: Synthetic polypeptide
QPVLTQSSSASASLGSSVKLTCTLSSGHSSYIIAWHQQQPGKAPRYLMKLEGSGSYNKGSGLPDRFSGSSSGADRYLTISNLQSEDEADYYCETWDGNTWVFGGGTQLTVLG

SEQ ID NO: 9355 - protein, 109 aa, Artificial Sequence
  Description of Artificial Sequence: Synthetic polypeptide
EIVLTQSPATLSLSPGERATLSCRTSQSSPSDNLAWYQHKPGQAPRLLIYGGSNRATGIPARFSGSGSGTDFTLTISSLEPEDFAVYYCQQYGSSPLTFGGGTKVDIKR

SEQ ID NO: 9356 - protein, 110 aa, Artificial Sequence
  Description of Artificial Sequence: Synthetic polypeptide
QSALTQPRSVSGSPGQSVTISCTGTSSDVGGYNYVSWYQQHPGKAPKLMIYDVIKRPSGVPDRFSGSRSGNTASLTISGLQAEDEADYYCCSYAGTHWVFGGGTKLTVLG

SEQ ID NO: 9357 - protein, 109 aa, Artificial Sequence
  Description of Artificial Sequence: Synthetic polypeptide
EIVLTQSPGTLSLSPGERATLSCRASQSGVTNFLAWYQQKPGQAPRLLIYATSSRATGIPDRFSGSASGTDFTLTITRLEPEDFAVYFCQQYASSPLTFGGGTKVEIKR

SEQ ID NO: 9358 - protein, 108 aa, Artificial Sequence
  Description of Artificial Sequence: Synthetic polypeptide
EIVLTQSPATLSLSPGERATLSCRASQSVSGHLDWYQQKPGQSPRLLIYDASNRATGIPARFSGSGSGTDFSLTISSLEPEDFAVYYCQHRSNWPWTFGQGTKVEIKR

SEQ ID NO: 9359 - protein, 112 aa, Artificial Sequence
  Description of Artificial Sequence: Synthetic polypeptide
QPVLTQSSSASASLGASVKLTCTLSSEHDRYAIAWLQQKPEKGPRYLMKVNSDGSHRKGDGIPDRFSGSSSGAERYLTISRLQSEDEADYYCQTWGIGIRVFGGGTQLTVLG

SEQ ID NO: 9360 - protein, 109 aa, Artificial Sequence
  Description of Artificial Sequence: Synthetic polypeptide
EIVLTQSPGTLSLSPGERATLSCRASQNIFISFLAWYQQKPGQAPRLLLYGASNRATGIPDRFSGSGSGTDFTLTISRLEPEDFAVYYCQQYGSSPLTFGGGTKVEIKR

SEQ ID NO: 9361 - protein, 109 aa, Artificial Sequence
  Description of Artificial Sequence: Synthetic polypeptide
EIVLTQSPGTLSLSPGERATLSCRASQNIGSNFLAWYQQKPGQAPRLLIYGASTRANGIPDRFSGSKSETDFTLTISRLEPEDFAVYYCQQYDNSPYTFGQGTKLEIKR

SEQ ID NO: 9362 - protein, 111 aa, Artificial Sequence
  Description of Artificial Sequence: Synthetic polypeptide
QSVLTQPPSVSAAPGQKVTISCSGSRSNVGGNFLSWYQHVPGTPPQLLIYDNYKRPSEIPDRFSGSKSGTSATLDITGLQTGDEADYYCGTWDSSLSSWVFGGGTQLTVLG

SEQ ID NO: 9363 - protein, 109 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRT

SEQ ID NO: 9364 - protein, 108 aa, Artificial Sequence
  Description of Artificial Sequence: Synthetic polypeptide
ENVLTQSPAIMSASPGEKVTMTCRARSSVSSSYLHWYQQKSGASPKLWIYSTSNLASGVPTRFSGSGSGTSYSLTISSVEAEDAATYYCQQYSGYPLTFGAGTKLELK

SEQ ID NO: 9365 - protein, 112 aa, Artificial Sequence; identical to SEQ ID NO: 9055
  Description of Artificial Sequence: Synthetic polypeptide

SEQ ID NO: 9366 - protein, 107 aa, Artificial Sequence [sequence omitted]

SEQ ID NO: 9367 - protein, 128 aa, Artificial Sequence
  Description of Artificial Sequence: Synthetic polypeptide
MDFQVQIISFLLISASVIMSRGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 9368 - protein, 215 aa, Artificial Sequence
  Description of Artificial Sequence: Synthetic polypeptide
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 9369 - protein, 125 aa, Artificial Sequence
  Description of Artificial Sequence: Synthetic polypeptide
QVQIISFLLISASVIMSRGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIK

SEQ ID NO: 9370 - protein, 107 aa, Artificial Sequence
  Description of Artificial Sequence: Synthetic polypeptide
EIVLTQSPSSLSASVGDRVTITCRASQGIGDDLGWYQQKPGKAPILLIYGTSTLQSGVPSRFSGSGSGTDFTLTINSLQPEDFATYYCLQDSNYPLTFGGGTRLEIK

SEQ ID NO: 9371 - protein, 107 aa, Artificial Sequence
  Description of Artificial Sequence: Synthetic polypeptide
DIQMTQSPSSLSASVGDRVTITCRASENIYSYLAWYQQKPGKAPKLLVSNAKTLAEGVPSRFSGSGSGKQFTLTISSLQPEDFATYYCQHHYGNSYPFGQGTKLEIK

SEQ ID NO: 9372 - protein, 107 aa, Artificial Sequence
  Description of Artificial Sequence: Synthetic polypeptide
DIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIK

SEQ ID NO: 9373 - protein, 107 aa, Artificial Sequence
  Description of Artificial Sequence: Synthetic polypeptide
DIQMTQTTSSLSASLGDRVTISCRASQDIHGYLNWYQQKPDGTVKLLIYYTSILHSGVPSRFSGSGSGTDYSLTISNLEQEDFATYFCQQGNTLPWTFGGGTKLEIK

SEQ ID NO: 9374 - protein, 107 aa, Artificial Sequence [sequence omitted]

SEQ ID NO: 9375 - protein, 114 aa, Artificial Sequence
  Description of Artificial Sequence: Synthetic polypeptide
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKR

SEQ ID NO: 9376 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPLYTFGQGTKLEIK

SEQ ID NO: 9377 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPIYTFGQGTKLEIK

SEQ ID NO: 9378 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPQYTFGQGTKLEIK

SEQ ID NO: 9379 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPKYTFGQGTKLEIK

SEQ ID NO: 9380 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPAYTFGQGTKLEIK

SEQ ID NO: 9381 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPVYTFGQGTKLEIK

SEQ ID NO: 9382 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPYYTFGQGTKLEIK

SEQ ID NO: 9383 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNWPFYTFGQGTKLEIK

SEQ ID NO: 9384 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNAPMYTFGQGTKLEIK

SEQ ID NO: 9385 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNDPMYTFGQGTKLEIK

SEQ ID NO: 9386 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNLPMYTFGQGTKLEIK

SEQ ID NO: 9387 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNNPMYTFGQGTKLEIK

SEQ ID NO: 9388 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNGPMYTFGQGTKLEIK

SEQ ID NO: 9389 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNQPMYTFGQGTKLEIK

SEQ ID NO: 9390 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNVPMYTFGQGTKLEIK

SEQ ID NO: 9391 - protein, 108 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFSGSGSGTDFTLTISSLEPEDFAVYYCQQRSNSPMYTFGQGTKLEIK

SEQ ID NO: 9392 - protein, 127 aa, Artificial Sequence; identical to SEQ ID NO: 8228
  Description of Artificial Sequence: Synthetic polypeptide

SEQ ID NO: 9393 - DNA, 467 bp, Artificial Sequence
  Description of Artificial Sequence: Synthetic polynucleotide
  Description of Combined DNA/RNA Molecule: Synthetic polynucleotide
  modified_base (69)..(69): a, c, t, g, unknown or other
  modified_base (72)..(72): a, c, t, g, unknown or other
  modified_base (74)..(74): a, c, t, g, unknown or other
  modified_base (82)..(82): a, c, t, g, unknown or other
  modified_base (85)..(86): a, c, t, g, unknown or other
  modified_base (89)..(89): a, c, t, g, unknown or other
  modified_base (96)..(98): a, c, t, g, unknown or other
  modified_base (106)..(106): a, c, t, g, unknown or other
  modified_base (108)..(109): a, c, t, g, unknown or other
  modified_base (443)..(444): a, c, t, g, unknown or other
gaattccgttgtagaaatgagaccgtctattcagttcctggggctcttgttgttctggcttcatggtgnctnangtgtgtanganntcnagatgunnncagtctcnannctcactgtctgcatctctgggaggcaaagtcaccatcgcttgcaaggcaagccaagacattaacaactatatagcttggtaccaacacaagcctggaaaaggtcctaggctactcattcattacacatctacattacaaccaggcatcccatcaaggttcagtggaagtggatctgggagagattattccttcagcatcagcaacctggagcctgaagatattgcaacttattattgtctacagtatgataatcttctgttcacgttcggaggggggaccaaactggaaataaacgggctgatgctgcaccaactgtatccatcttcccaccannagtgagcagttaacatctggagg

SEQ ID NO: 9394 - protein, 111 aa, Artificial Sequence
  Description of Artificial Sequence: Synthetic polypeptide
QSVLTQPPSASGTPGQRVTISCSGSNTNIGKNYVSWYQQLPGTAPKLLIYANSNRPSGVPDRFSGSKSGTSASLAISGLRSEDEADYYCASWDASLNGWVFGGGTKLTVLG

SEQ ID NO: 9395 - protein, 108 aa, Artificial Sequence
  Description of Artificial Sequence: Synthetic polypeptide
  MOD_RES (36)..(36): Any amino acid
DIQMTQSPSSLSASVGDRVTITCRASKTISKYLAWXQQKPGKAPKLLIYSGSTLQSGVPSRFSGSGSGTDFTLTISSLQPEDFATYYCQQHNEYPLTFGQGTKVEIKR

SEQ ID NO: 9396 - protein, 108 aa, Artificial Sequence
  Description of Artificial Sequence: Synthetic polypeptide
ETVLTQSPGTLSLSPGERATLSCRASQSLGSSYLAWYQQKPGQAPRLLIYGASSRAPGIPDRFSGSGSGTDFTLTISRLEPEDFAVYYCQQYADSPITFGQGTRLEIK

SEQ ID NO: 9397 - protein, 108 aa, Artificial Sequence
  Description of Artificial Sequence: Synthetic polypeptide
EIVLTQSPGTLSLSPGERATLSCRASQSVRGRYLAWYQQKPGQAPRLLIYGASSRATGIPDRFSGSGSGTDFTLTISRLEPEDFAVFYCQQYGSSPRTFGQGTKVEIK

SEQ ID NO: 9398 - protein, 107 aa, Artificial Sequence [sequence omitted]

SEQ ID NO: 9399 - protein, 109 aa, Artificial Sequence
  Description of Artificial Sequence: Synthetic polypeptide
  MOD_RES (1)..(1): Any amino acid
XIVLTQSPATLSLSPGERATLSCRASQSVSDAYLAWYQQKPGQAPRLLIYDASSRATGVPARFSGSGSGTDFTLTISSLEPEDFAVYYCHQYIQLHSFTFGQGTKVEIK

SEQ ID NO: 9400 - protein, 106 aa, Artificial Sequence
  Description of Artificial Sequence: Synthetic polypeptide
EIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIK

SEQ ID NO: 9401 - protein, 486 aa, Artificial Sequence
  Description of Artificial Sequence: Synthetic polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 9402 - protein, 107 aa, Artificial Sequence
  Description of Artificial Sequence: Synthetic polypeptide
DIQMTQSPSSLSASVGDRVTITCRASGNIYGWLAWYQQTPGKAPKLLIYQAKTLMDGVPSRFSGSGSGTDYTFTISSLQPEDIATYYCQHFWNIPATFGQGTKLQIT

SEQ ID NO: 9403 - protein, 107 aa, Artificial Sequence; identical to SEQ ID NO: 9040
  Description of Artificial Sequence: Synthetic polypeptide

SEQ ID NO: 9404 - protein, 107 aa, Artificial Sequence
  Description of Artificial Sequence: Synthetic polypeptide
GIQMTQSPSSLSASVGDRVTITCRASGNIYQYLTWYQQTPGKAPKLLIYNAKTLAEGVPSRFSGSSSGTDYTFTISSLQPEDIATYYCQHFWKLPYTFGQGTKLQIT

SEQ ID NO: 9405 - protein, 107 aa, Artificial Sequence; identical to SEQ ID NO: 9404
  Description of Artificial Sequence: Synthetic polypeptide

SEQ ID NO: 9406 - protein, 107 aa, Artificial Sequence
  Description of Artificial Sequence: Synthetic polypeptide
DIQMTQSPSSLSASVGDRVTITCRASGNIYEYLTWYQQTPGKAPKLLIYNAKTLAEGVPSRFSGSSSGTDYTFTISSLQPEDIATYYCQHFWKLPYTFGQGTKLQIT

SEQ ID NO: 9407 - protein, 107 aa, Artificial Sequence
  Description of Artificial Sequence: Synthetic polypeptide
GIQMAQSPSSLSASVGDRVTITCRASGNIYEYLTWYQQTPGKAPKLLIYNAKTLAEGVPSRFSGSSSGTDYTFTISSLQPEDIATYYCQHFWKLPYTFGQGTKLQIT

SEQ ID NO: 9408 - protein, 107 aa, Artificial Sequence
  Description of Artificial Sequence: Synthetic polypeptide
GIQMTQSPSSLSASVGDRVTITCRASGNIYTYLTWYQQTPGKAPKLLIYNAKTLAEGVPSRFSGSSSGTDYTFTISSLQPEDIATYYCQHFWSLPYTFGQGTKLQIT

SEQ ID NO: 9409 - protein, 107 aa, Artificial Sequence
  Description of Artificial Sequence: Synthetic polypeptide
GIQMTQSPSSLSASVGDRVTITCRASGNIYHYLTWYQQTPGKAPKLLIYDAKTLAEGVPSRFSGSSSGTDYTFTISSLQPEDIATYYCQHFWSLPYTFGQGTKLQIT

SEQ ID NO: 9410 - protein, 107 aa, Artificial Sequence
  Description of Artificial Sequence: Synthetic polypeptide
GIQMTQSPSSLSASVGDRVTITCRASGNIYHYLTWYQQTPGKAPKLLIYNAKTLAEGVPSRFSGSSSGTDYTFTISSLQPEDIATYYCQHFWSLPYTFGQGTKLQIT

SEQ ID NO: 9411 - protein, 107 aa, Artificial Sequence
  Description of Artificial Sequence: Synthetic polypeptide
GIQMTQSPSSLSASVGDRVTITCRASGNIYHYLTWYQQTPGKAPKLLIYNAKTLAEGVPSRFSGSCSGTDYTFTISSLQPEDIATYYCQHFWSLPYTFGQGTKLQIT

SEQ ID NO: 9412 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLADGVPSRFSGSSSGTDYTFTISSLQPEDIATYYCQHFWTLPYTFGQGTKLQIT

SEQ ID NO: 9413 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLADGVPSRFSGSSSGTDYTLTISSLQPEDIATYYCQHFWTLPYTFGQGTKLQIT

SEQ ID NO: 9414 - protein, 107 aa, Artificial Sequence
  Description of Artificial Sequence: Synthetic polypeptide
GIQMTQSPSSLSASVGDRVTITCRASGNIYTYLTWYQQTPGKAPKLLIYNAKTLADGVPSRFSGSGSGTDYTFTISSLQPEDIATYYCQHFWTLPYTFGQGTKLQIT

SEQ ID NO: 9415 - protein, 107 aa, Artificial Sequence
  Description of Artificial Sequence: Synthetic polypeptide
GIQMTQSPSSLSASVGDRVTITCRASGNIYQYLTWYQQTPGKAPKLLIYNAKTLADGVPSRFSGSGSGTDYTFTISSLQPEDIATYYCQHFWTLPYTFGQGTKLQIT

SEQ ID NO: 9416 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLADGVPSRFSGSGSGTDYTFTISSLQPEDIATYYCQHFWTLPYTFGQGTKLQIT

SEQ ID NO: 9417 - protein, 107 aa, Artificial Sequence
  Description of Artificial Sequence: Synthetic polypeptide
GIQMTQSPSSLSASVGDRVTITCRASGNIYDYLTWYQQTPGKAPKLLIYNAKTLADGVPSRFSGSCSGTDYTFTISSLQPEDIATYYCQHFWTLPYTFGQGTKLQIT

SEQ ID NO: 9418 - protein, 107 aa, Artificial Sequence
  Description of Artificial Sequence: Synthetic polypeptide
GIQMTQSPSSLSASVGDRVTITCRASGNIYDYLTWYQQTPGKAPKLLIYNAKTLADGVPSRFSGSCSGTDYTFTISSLQPEDIATYYCQHFWSLPYTFGQGTKLQIT

SEQ ID NO: 9419 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLADGVPSRFSGSCSGTDYTFTISSLQPEDIATYYCQHFWKLPYTFGQGTKLQIT

SEQ ID NO: 9420 - protein, 107 aa, Artificial Sequence
  Description of Artificial Sequence: Synthetic polypeptide
GIQMTQSPSSLSASVGDRVTITCRASGNIYKYLTWYQQTPGKAPKLLIYDAKTLADGVPSRFSGSVSGTDYTFTISSLQPEDIATYYCQHFWRLPYTFGQGTKLQIT

SEQ ID NO: 9421 - protein, 107 aa, Artificial Sequence
  Description of Artificial Sequence: Synthetic polypeptide
GIQMTQSPSSLSASVGDRVTITCRASGNIYKYLTWYQQTPGKAPKLLIYDAKTLADGVPSRFSGSSSGTDYTFTISSLQPEDIATYYCQHFWRLPYTFGQGTKLQIT

SEQ ID NO: 9422 - protein, 107 aa, Artificial Sequence
  Description of Artificial Sequence: Synthetic polypeptide
GIQMTQSPSSLSASVGDRVTITCRASGNIYHYLTWYQQTPGKAPKLLIYDAKNLADGVPSRFSGSCSGTDYTFTISSLQPEDIATYYCQHFWSLPYTFGQGTKLQIT

SEQ ID NO: 9423 - protein, 107 aa, Artificial Sequence
  Description of Artificial Sequence: Synthetic polypeptide
GIQMTQSPSSLSASVGDRVTITCRASGNIYHYLTWYQQTPGKAPKLLIYDAKTLADGVPSRFSGSSSGTDYTFTISSLQPEDIATYYCQHFWSLPYTFGQGTKLQIT

SEQ ID NO: 9424 - protein, 107 aa, Artificial Sequence
  Description of Artificial Sequence: Synthetic polypeptide
GIQMTQSPSSLSASVGDRVTITCRASGNIYQYLTWYQQTPGKAPKLLIYDAKILADGVPSRFSGSSSGTDYTFTISSLQPEDIATYYCQHFWKLPYTFGQGTKLQIT

SEQ ID NO: 9425 - protein, 107 aa, Artificial Sequence
  Description of Artificial Sequence: Synthetic polypeptide
GIQMTQSPSSLSASVGDRVTITCRASGNIYHYLTWYQQTPGKAPKLLIYDAKILADGVPSRFSGSSSGTDYTFTISSLQPEDIATYYCQHFWKLPYTFGQGTKLQIT

SEQ ID NO: 9426 - protein, 107 aa, Artificial Sequence; identical to SEQ ID NO: 9402
  Description of Artificial Sequence: Synthetic polypeptide

SEQ ID NO: 9427 - protein, 107 aa, Artificial Sequence
  Description of Artificial Sequence: Synthetic polypeptide
DIQMTQSPSSLSASVGDRVTITCRASGNIYTYLNWYQQTPGKAPKLLIYDAKTLADGVPSRFSGSSSGTDYTFTISSLQPEDIATYYCQHFWRLPYTFGQGTKLQIT

SEQ ID NO: 9428 - protein, 107 aa, Artificial Sequence
  Description of Artificial Sequence: Synthetic polypeptide
DIQMTQSPSSLSASVGDRVTITCRASGNIYTYLNWYQQTPGKAPKLLIYNAKELAEGVPSRFSGSGSGTDYTFTISSLQPEDIATYYCQHFWRLPYTFGQGTKLQIT

SEQ ID NO: 9429 - protein, 107 aa, Artificial Sequence
  Description of Artificial Sequence: Synthetic polypeptide
DIQMTQSPSSLSASVGDRVTITCRASGNIYTYLNWYQQTPGKAPKLLIYNAKSLADGVPSRFSGSCSGTDYTFTISSLQPEDIATYYCQHFWRIPYTFGQGTKLQIT

SEQ ID NO: 9430 - protein, 107 aa, Artificial Sequence
  Description of Artificial Sequence: Synthetic polypeptide
DIQMTQSPSSLSASVGDRVTITCRASGNIYTYLTWYQQTPGKAPKLLIYDAKTLADGVPSRFSGSSSGTDYTFTISSLQPEDIATYYCQHFWKLPYTFGQGTKLQIT

SEQ ID NO: 9431 - protein, 107 aa, Artificial Sequence
  Description of Artificial Sequence: Synthetic polypeptide
DIQMTQSPSSLSASVGDRVTITCRASGNIYNYLTWYQQTPGKAPKLLIYNAKNLADGVPSRFSGSVSGTDYTFTISSLQPEDIATYYCQHFWRLPYTFGQGTKLQIT

SEQ ID NO: 9432 - protein, 107 aa, Artificial Sequence
  Description of Artificial Sequence: Synthetic polypeptide
DIQMTQSPSSLSASVGDRVTITCRASGNIWHYLTWYQQTPGKAPKLLIYDAKTLADGVPSRFSGSSSGTDYTLTISSLQPEDIATYYCQHFWRLPYTFGQGTKLQIT

SEQ ID NO: 9433 - protein, 107 aa, Artificial Sequence
  Description of Artificial Sequence: Synthetic polypeptide
DIQMTQSPSSLSASVGDRVTITCRASGNIYHYLTWYQQTPGKAPKLLIYNAKTLASGVPSRFSGSSSGTDYTLTISSLQPEDIATYYCQHFWKLPYTFGQGTKLQIT

SEQ ID NO: 9434 - protein, 107 aa, Artificial Sequence
  Description of Artificial Sequence: Synthetic polypeptide
DIQMTQSPSSLSASVGDRVTITCRASGNIYDYLTWYQQTPGKAPKLLIYNAKILADGVPSRFSGSGSGTDYTLTISSLQPEDIATYYCQHFWMLPYTFGQGTKLQIT

SEQ ID NO: 9435 - protein, 107 aa, Artificial Sequence
  Description of Artificial Sequence: Synthetic polypeptide
GIQMTQSPSSLSASVGDRVTITCRASGNIYTYLTWYQQIPGKAPKLLIYDAKTLAEGVPSRFSGSGSGTDYTFTISSLQPEDIATYYCQHFWKIPYTFGQGTKLQIT

SEQ ID NO: 9436 - protein, 107 aa, Artificial Sequence
  Description of Artificial Sequence: Synthetic polypeptide
DIQMTQSPSSLSASVGDRVTITCRASGNIYHYLTWYQQTPGKAPKLLIYNAKTLAEGVPSRFSGSCSGADYTFTISSLQPEDIATYYCQQFWKIPYTFGQGTKLQIT

SEQ ID NO: 9437 - protein, 107 aa, Artificial Sequence
  Description of Artificial Sequence: Synthetic polypeptide
DIQMTQSPSSLSASVGDRVTITCRASGNIYNYLTWYQQTPGKAPKLLIYNAKTLAEGVPSRFSGSDSGTDYTFTISSLQPEDIATYYCQHFWKLPYTFGQGTKLQIT

SEQ ID NO: 9438 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLAAGVPSRFSGSGSGTDYTFTISSLQPEDIATYYCQHFWKLPYTFGQGTKLQIT

SEQ ID NO: 9439 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLAEGVPSRFSGSGSGTDYTFTISSLQPEDIATYYCQHFWKLPYTFGQGTKLQIT

SEQ ID NO: 9440 - protein, 107 aa, Artificial Sequence
  Description of Artificial Sequence: Synthetic polypeptide
GIQMTQSPSSLSASVGDRVTITCRASGNIYNYLTWYQQTPGKAPKLLIYNAKTLEEGVPSRFSGSSSGTDYTFTISSLQPEDIATYYCQHFWTLPYTFGQGTKLQIT

SEQ ID NO: 9441 - protein, 107 aa, Artificial Sequence
  Description of Artificial Sequence: Synthetic polypeptide
GIQMTQSPSSLSASVGDRVTITCRASGNIYGYLTWYQQTPGKAPKLLIYNAKTLEEGVPSRFSGSGSGTDYTFTISSLQPEDIATYYCQHFWTLPYNFGQGTKLQIT

SEQ ID NO: 9442 - protein, 107 aa, Artificial Sequence
  Description of Artificial Sequence: Synthetic polypeptide
GIQMTQSPSSLSASVGDRVTITCRASGNIYDYLTWYQQTPGKAPKLLIYNAKTLAEGVPSRFSGSGSGTDYTFTISSLQPEDIATYYCQHFWTLPYTFGQGTKLQIT

SEQ ID NO: 9443 - protein, 108 aa, Artificial Sequence
  Description of Artificial Sequence: Synthetic polypeptide
EIVLTQSPATLSLSPGERATLSCRASQSVYSYLAWYQQKPGQAPRLLIYDASNRATGIPARFSGSGSGTDFTLTISSLEPEDFAVYYCQQRSNWPPFTFGPGTKVDIK

SEQ ID NO: 9444 - protein, 12 aa, Artificial Sequence
  Description of Artificial Sequence: Synthetic peptide
RASQDVNTAVAW

SEQ ID NO: 9445 - protein, 7 aa, Artificial Sequence
  Description of Artificial Sequence: Synthetic peptide
SASFLYS

SEQ ID NO: 9446 - protein, 9 aa, Artificial Sequence
  Description of Artificial Sequence: Synthetic peptide
QQHYTTPPT

SEQ ID NO: 9447 - protein, 107 aa, Artificial Sequence
  Description of Artificial Sequence: Synthetic polypeptide
DIVMTQSPSFLSASVGDRVTITCKASQNVITAVAWYQQKPGKSPKLLIYSASNRYTGVPDRFSGSGSGTDFTLTISSLQPEDFADYFCQQYNSYPYTFGGGTKLEIK

SEQ ID NO: 9448 - protein, 107 aa, Artificial Sequence
  Description of Artificial Sequence: Synthetic polypeptide
DIVMTQSPDSLAVSLGERATINCKASQNVITAVAWYQQKPGQSPKLLIYSASNRYTGVPDRFSGSGSGTDFTLTISSLQAEDVADYFCQQYNSYPYTFGGGTKLEIK

SEQ ID NO: 9449 - protein, 107 aa, Artificial Sequence
  Description of Artificial Sequence: Synthetic polypeptide
DIVMTQSPSFMSTSVGDRVTITCKASQNVITAVAWYQQKPGKSPKLLIYSASNRYTGVPDRFSGSGSGTDFTLTISSMQPEDFADYFCQQYNSYPYTFGGGTKLEIK

SEQ ID NO: 9450 - protein, 97 aa, Artificial Sequence
  Description of Artificial Sequence: Synthetic polypeptide
DIVMTQSPDSMATSLGERVTINCKASQNVITAVAWYQQKPGQSPKLLIYSASNRYTGVPDRFSGSGSGTDFTLTISSMQAEDVADYFCQQYNSYPYT

SEQ ID NO: 9451 - protein, 112 aa, Artificial Sequence
  Description of Artificial Sequence: Synthetic polypeptide
DVVMTQSPPSLLVTLGQPASISCRSSQSLLHSSGNTYLNWLLQRPGQSPQPLIYLVSKLESGVPDRFSGSGSGTDFTLKISGVEAEDVGVYYCMQFTHYPYTFGQGTKLEIK

SEQ ID NO: 9452 - protein, 139 aa, Artificial Sequence
  Description of Artificial Sequence: Synthetic polypeptide
MKHLWFFLLLVAAPRWVLSQVQLQEAGPGLVKPSETLSLTCSVSGGSISGDYYWFWIRQSPGKGLEWIGYIYGSGGGTNYNPSLNNRVSISIDTSKNLFSLKLRSVTAADTAVYYCASNILKYLHWLLYWGQGVLVTVS

SEQ ID NO: 9453 - protein, 124 aa, Artificial Sequence
  Description of Artificial Sequence: Synthetic polypeptide
MVSSAQFLGLLLLCFQGTRCDIQMTQTTSSLSASLGDRVTISCRASQDISSYLNWYQQKPDGTIKLLIYYTSRLHSGVPSRFSGSGTDYSLTINNLEQEDIATYFCQQGNTLPYTFGGTKLEIN

SEQ ID NO: 9454 - protein, 106 aa, Artificial Sequence
  Description of Artificial Sequence: Synthetic polypeptide
DIQMTQSPSSLSASVGDRVTITCRASSSVSYIHWFQQKPGKAPKPLIYAASSLQSGVPSRFSGSGSGTDYTLTISSLQPEDFATYYCQQWTSNPPTFGGGTKLEIK

SEQ ID NO: 9455 - protein, 106 aa, Artificial Sequence
  Description of Artificial Sequence: Synthetic polypeptide
DIQMTQSPSSLSASVGDRVTITCRASSSVSYIHWFQQKPGKAPKPLIYAASSLQSGVPSRFSGSGSGTDYTLTISSLQPEDFATYYCQQWQSNPPTFGGGTKLEIK

SEQ ID NO: 9456 - protein, 121 aa, Artificial Sequence
  Description of Artificial Sequence: Synthetic polypeptide
QVQLVQSGAEVKKPGSSVKVSCKASGYTFTSYNMHWVRQAPGQGLEWIGAIYPGNGDTSYNQKFKGKATITADKSTSTAYMELSSLRSDDTAVYYCARSTYYGGDWNFNNWGQGTLVTVSS

SEQ ID NO: 9457 - protein, 121 aa, Artificial Sequence
  Description of Artificial Sequence: Synthetic polypeptide
QVQLVQSGAEVKKPGSSVKVSCKASGYTFTSYNMHWVRQAPGQGLEWIGAIYPGNGDTSYNQKFKGKATITADKSTSTAYMELSSLRSDDTAVYYCARSTYYAGDWNFNNWGQGTLVTVSS

SEQ ID NO: 9458 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9459 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9460 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9461 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKNPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9462 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKGPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9463 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKQPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9464 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKVPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9465 - protein, 214 aa, Artificial Sequence
  Description of Artificial Sequence: Synthetic polypeptide
DIQMTQSPGTLSLSPGERATLSCRASQSVSSYLAWYQQKPGQAPRLLIYDASNRATGIPARFSGSGSGTEFTLTISSLQSEDFAVYYCQQYDKSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9466 - protein, 238 aa, Artificial Sequence
  Description of Artificial Sequence: Synthetic polypeptide
MVLQTQVFISLLLWISGAYGDIVMTQSPDSLAVSLGERATINCRASESVDSYGNSFMHWYQQKPGQPPKLLIYRASNLESGVPDRFSGSGSGTDFTLTISSLQAEDVAVYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9467 - protein, 238 aa, Artificial Sequence
  Description of Artificial Sequence: Synthetic polypeptide
MVLQTQVFISLLLWISGAYGDIVMTQSPDSLAVSLGERATINCRASESVDSYGNSFMHWYQQKPGQPPKLLIYWASTRESGVPDRFSGSGSGTDFTLTISSLQAEDVAVYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9468 - protein, 240 aa, Artificial Sequence
  Description of Artificial Sequence: Synthetic polypeptide
MDMRVPAQLLGLLLLWLRGARCDIQMTQSPSSLSASVGDRVTITCRASESVDSYGNSFMHWYQQKPGKAPKLLIYRASNLESGVPSRFSGSGSGTDFTLTISSLQPEDFATYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9469 - protein, 213 aa, Artificial Sequence
  Description of Artificial Sequence: Synthetic polypeptide
QPGLTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 9470 - protein, 216 aa, Artificial Sequence
  Description of Artificial Sequence: Synthetic polypeptide
QSVLTQPPSASGTPGQRVTISCSGSNTNIGKNYVSWYQQLPGTAPKLLIYANSNRPSGVPDRFSGSKSGTSASLAISGLRSEDEADYYCASWDASLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9471 - protein, 214 aa, Artificial Sequence
  Description of Artificial Sequence: Synthetic polypeptide
EIVMTQSPATLSVSPGERATLSCRASQSIGTNIHWYQQKPGQAPRLLIYYASESISGIPARFSGSGSGTEFTLTISSLQSEDFAVYYCQQSWSWPTTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9472 - protein, 109 aa, Artificial Sequence
  Description of Artificial Sequence: Synthetic polypeptide
DIQMTQSPSSVSASVGDRVTITCRASQDISSWLAWYQQKPGKAPKLLIYAASSLQSGVPSRFSGSGSGTDFTLTISSLQPEDFATYYCQQASSFPSITFGQGTRLEIKR

SEQ ID NO: 9473 - protein, 126 aa, Artificial Sequence
  Description of Artificial Sequence: Synthetic polypeptide
METDTLLLWVLLLWVPGSTGDIQMTQSPSSLSASVGDRVTITCSASSSVSYMNWYQQKPGKAPKRLIYDTSKLASGVPSRFSGSGSGTDFTLTISSLQPEDFATYYCQQWSSNPPTFGGGTKVEIK

SEQ ID NO: 9474 - protein, 204 aa, Artificial Sequence
  Description of Artificial Sequence: Synthetic polypeptide
KFLLVSAGDRVTITCKASQSVSNDVAWYQQKPGQSPKLLIYYASNRYTGVPDRFTGSGYGTDFTFTISTVQAEDLAVYFCQQDYSSPYTFGGGTKLEIKRADAAPTVSIFPPSSEQLTSGGASWCFLNNFYPKDINVKWKIDGSERQNGVLNSWTDQDSKDSTYSMSSTLTTKDEYERHNSYTCEATHKTSTSPIVKSFNRNEC

SEQ ID NO: 9475 - protein, 214 aa, Artificial Sequence
  Description of Artificial Sequence: Synthetic polypeptide
EIVLTQSPATLSVSPGERATLSCRASQSVGTNVAWYQQKPGQAPRVLIYSTSSRATGITDRFSGSGSGTDFTLTISRLEPEDFAVYYCQQFNKSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9476 - protein, 214 aa, Artificial Sequence
  Description of Artificial Sequence: Synthetic polypeptide
DIQMTQSPSSLSASVGDRVTITCKASRDVAIAVAWYQQKPGKVPKLLIYWASTRHTGVPSRFSGSGSRTDFTLTISSLQPEDVADYFCHQYSSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9477 - protein, 214 aa, Artificial Sequence; identical to SEQ ID NO: 9288
  Description of Artificial Sequence: Synthetic polypeptide

SEQ ID NO: 9478 - protein, 215 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9479 - protein, 235 aa, Artificial Sequence
  Description of Artificial Sequence: Synthetic polypeptide
MGWSCIILFLVATATGVHSDIQLTQPNSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9480 - protein, 213 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9481 - protein, 236 aa, Artificial Sequence
  Description of Artificial Sequence: Synthetic polypeptide
MDMRVPAQLLGLLLLWFPGSRCDIQMTQSPSSVSASVGDRVTITCRASQGISSWLAWYQQKPGKAPKLLIYEASNLETGVPSRFSGSGSGSDFTLTISSLQPEDFATYYCQQTSSFLLSFGGGTKVEHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9482 - protein, 214 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9483 - protein, 215 aa, Artificial Sequence
  Description of Artificial Sequence: Synthetic polypeptide
ETVLTQSPGTLSLSPGERATLSCRASQSLGSSYLAWYQQKPGQAPRLLIYGASSRAPGIPDRFSGSGSGTDFTLTISRLEPEDFAVYYCQQYADSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9484 - protein, 214 aa, Artificial Sequence
  Description of Artificial Sequence: Synthetic polypeptide
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9485 - protein, 214 aa, Artificial Sequence
  Description of Artificial Sequence: Synthetic polypeptide
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9486 - protein, 235 aa, Artificial Sequence
  Description of Artificial Sequence: Synthetic polypeptide
METPAQLLFLLLLWLPDTTGEIVLTQSPGTLSLSPGERATLSCRASQSVRGRYLAWYQQKPGQAPRLLIYGASSRATGIPDRFSGSGSGTDFTLTISRLEPEDFAVFYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9487 - protein, 215 aa, Artificial Sequence
  Description of Artificial Sequence: Synthetic polypeptide
EIVLTQSPGTLSLSPGERATLSCRASQSVRGRYLAWYQQKPGQAPRLLIYGASSRATGIPDRFSGSGSGTDFTLTISRLEPEDFAVFYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9488 - protein, 107 aa, Artificial Sequence
  Description of Artificial Sequence: Synthetic polypeptide
DIQMTQSPASLSASVGETVTITCGASENIYGALNWYQRKQGKSPQLLIYGATNLADGMSSRFSGSGSGRQYYLKISSLHPDDVATYYCQNVLNTPLTFGAGTKLELK

SEQ ID NO: 9489 - protein, 217 aa, Artificial Sequence
  Description of Artificial Sequence: Synthetic polypeptide
QSVLTQPPSVSGAPGQRVTISCTGSSSNIGSGYDVHWYQQLPGTAPKLLIYGNSKRPSGVPDRFSGSKSGTSASLAITGLQSEDEADYYCASWTDGLSLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9490 - protein, 213 aa, Artificial Sequence; identical to SEQ ID NO: 7957
  Description of Artificial Sequence: Synthetic polypeptide

SEQ ID NO: 9491 - protein, 214 aa, Artificial Sequence
  Description of Artificial Sequence: Synthetic polypeptide
DIQMTQSPSSLSASVGDRVTITCKASRDIRSYLTWYQQKPGKAPKTLIYYATSLADGVPSRFSGSGSGQDYSLTISSLESDDTATYYCLQHGESPFTLGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9492 - protein, 109 aa, Artificial Sequence
  Description of Artificial Sequence: Synthetic polypeptide
DIQMTQSPSSLSASVGDRVTITCKASRDIRSYLTWYQQKPGKAPKTLIYYATSLADGVPSRFSGSGSGQDYSLTISSLESDDTATYYCLQHGESPFTFGSGTKLEIKRA

SEQ ID NO: 9493 - protein, 107 aa, Artificial Sequence
  Description of Artificial Sequence: Synthetic polypeptide
DIQMTQSPSSLSASVGDRVTITCKASRDIRSYLTWYQQKPGKAPKTLIYYATSLADGVPSRFSGSGSGQDYSLTISSLESDDTATYYCLQHGESPFTLGSGTKLEIK

SEQ ID NO: 9494 - protein, 213 aa, Artificial Sequence
  Description of Artificial Sequence: Synthetic polypeptide
AIQLTQSPSSLSASVGDRVTITCRASQGISSALAWYQQKPGKAPKLLIYDASNLESGVPSRFSGSGSGTDFTLTISSLQPEDFATYYCQQFNSYPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9495 - protein, 218 aa, Artificial Sequence
  Description of Artificial Sequence: Synthetic polypeptide
DIVMTQSPDSLAVSLGERATINCRASKSVSTSGYSYIYWYQQKPGQPPKLLIYLASILESGVPDRFSGSGSGTDFTLTISSLQAEDVAVYYCQHSRELPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9496 - protein, 214 aa, Artificial Sequence
  Description of Artificial Sequence: Synthetic polypeptide
AIQLTQSPSSLSASVGDRVTITCRADESVRTLMHWYQQKPGKAPKLLIYLVSNSEIGVPDRFSGSGSGTDFRLTISSLQPEDFATYYCQQTWSDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9497 - protein, 238 aa, Artificial Sequence
  Description of Artificial Sequence: Synthetic polypeptide
METDTLLLWVLLLWVPGSTGDIVLTQSPATLSVSPGERATISCRASQRVSSSTYSYMHWYQQKPGQPPKLLIKYASNLESGVPARFSGSGSGTDFTLTISSVEPEDFATYYCQHSWEIPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9498 - protein, 217 aa, Artificial Sequence
  Description of Artificial Sequence: Synthetic polypeptide
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9499 - protein, 216 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9500 - protein, 214 aa, Artificial Sequence
  Description of Artificial Sequence: Synthetic polypeptide
AIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9501 - protein, 217 aa, Artificial Sequence; identical to SEQ ID NO: 7790
  Description of Artificial Sequence: Synthetic polypeptide

SEQ ID NO: 9502 - protein, 213 aa, Artificial Sequence
  Description of Artificial Sequence: Synthetic polypeptide
EIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9503 - protein, 214 aa, Artificial Sequence
  Description of Artificial Sequence: Synthetic polypeptide
DIQMTQSPSSLSASVGDRVTITCRASQAVSSAVAWYQQKPGKAPKLLIYSASHRYTGVPSRFSGSGSGTDFTLTISSLQPEDFATYYCQESYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9504 - protein, 214 aa, Artificial Sequence
  Description of Artificial Sequence: Synthetic polypeptide
DIQMTQSPSSVSASVGDRVTIACRASQNIRNILNWYQQRPGKAPQLLIYAASNLQSGVPSRFSGSGSGTDFTLTINSLQPEDFATYYCQQSYSMPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9505 - protein, 214 aa, Artificial Sequence
  Description of Artificial Sequence: Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9506 - protein, 214 aa, Artificial Sequence
  Description of Artificial Sequence: Synthetic polypeptide
DIQMTQSPSSLSASVGDRVTITCRASEDLYYNLAWYQRKPGKAPKLLIYDTYRLADGVPSRFSGSGSGTDYTLTISSLQPEDFASYYCQQYYKFPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9507 - protein, 236 aa, Artificial Sequence
  Description of Artificial Sequence: Synthetic polypeptide
MDMRVPAQLLGLLLLWLRGARCDIQMTQSPSSLSASVGDRVTITCRASEDLYYNLAWYQRKPGKAPKLLIYDTYRLADGVPSRFSGSGSGTDYTLTISSLQPEDFASYYCQQYYKFPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9508 - protein, 215 aa, Artificial Sequence
  Description of Artificial Sequence: Synthetic polypeptide
EIVLTQSPGTLSLSPGERATLSCRASQSVSSSFFAWYQQKPGQAPRLLIYGASSRATGIPDRLSGSGSGTDFTLTITRLEPEDFAVYYCQQYDSSAITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9509 - protein, 218 aa, Artificial Sequence
  Description of Artificial Sequence: Synthetic polypeptide
DIQMTQSPSSLSASVGDRVTITCRASQSVSTSSYSYMHWYQQKPGKAPKVLISYASNLESGVPSRFSGSGSGTDFTLTISSLQPEDFATYYCQHSWGIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9510 - protein, 238 aa, Artificial Sequence
  Description of Artificial Sequence: Synthetic polypeptide
MGWSCIILFLVATATGVHSDVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9511 - protein, 106 aa, Artificial Sequence; identical to SEQ ID NO: 7954
  Description of Artificial Sequence: Synthetic polypeptide

SEQ ID NO: 9512 - protein, 213 aa, Artificial Sequence
  Description of Artificial Sequence: Synthetic polypeptide
QIVLTQSPAIMSASPGEKVTITCSASSSVSYMNWFQQKPGTSPKLWIYSTSNLASGVPARFSGSGSGTSYSLTISRMEAEDAATYYCQQRSSYPNTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 9513 - protein, 214 aa, Artificial Sequence
  Description of Artificial Sequence: Synthetic polypeptide
DIELTQSPASLSASVGETVTITCQASENIYSYLAWHQQKQGKSPQLLVYNAKTLAGGVSSRFSGSGSGTHFSLKIKSLQPEDFGIYYCQHHYGILPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 9514 - protein, 214 aa, Artificial Sequence; identical to SEQ ID NO: 7860
  Description of Artificial Sequence: Synthetic polypeptide

SEQ ID NO: 9515 - protein, 214 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9516 - protein, 108 aa, Artificial Sequence
  Description of Artificial Sequence: Synthetic polypeptide
DIQMTQSPSSLSASVGDRVTITCSASQDISNYLNWYQQKPDKAPKLLIFYSSNLHSGVPSRFSGGGSGTDYTLTISSLQPEDIATYFCHQYSKLPWTFGQGTKVEIKR

SEQ ID NO: 9517 - protein, 210 aa, Artificial Sequence
  Description of Artificial Sequence: Synthetic polypeptide
QIVSTQSPAIMSASPGEKVTMTCSASSSRSYMQWYQQKPGTSPKRWIYDTSKLASGVPARFSGSGSGTSYSLTISSMEAEDAATYYCHQRSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 9518 - protein, 214 aa, Artificial Sequence; identical to SEQ ID NO: 7361
  Description of Artificial Sequence: Synthetic polypeptide

SEQ ID NO: 9519 - protein, 394 aa, Artificial Sequence [sequence omitted]

SEQ ID NO: 9520 - protein, 465 aa, Artificial Sequence
  Description of Artificial Sequence: Synthetic polypeptide
MEWSRVFIFLLSVTAGVHSQVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARDGPWFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 9521 - protein, 243 aa, Artificial Sequence
  Description of Artificial Sequence: Synthetic polypeptide
MHQTSMGIKMESQTLVFISILLWLYGADGNIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 9522 - protein, 443 aa, Artificial Sequence; identical to SEQ ID NO: 4856
  Description of Artificial Sequence: Synthetic polypeptide

SEQ ID NO: 9523 - protein, 209 aa, Artificial Sequence; identical to SEQ ID NO: 7529
  Description of Artificial Sequence: Synthetic polypeptide

SEQ ID NO: 9524 - protein, 259 aa, Artificial Sequence
  Description of Artificial Sequence: Synthetic polypeptide
EVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSSAAAEVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSS

SEQ ID NO: 9525 - protein, 236 aa, Artificial Sequence
  Description of Artificial Sequence: Synthetic polypeptide
QIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELKGTTAASGSSGGSSSGAEVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVS

SEQ ID NO: 9526 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 9527 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9528 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 9529 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9530 - protein, 242 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 9531 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9532 - protein, 486 aa, Artificial Sequence; identical to SEQ ID NO: 4589
  Description of Artificial Sequence: Synthetic polypeptide

SEQ ID NO: 9533 - protein, 486 aa, Artificial Sequence; identical to SEQ ID NO: 4590
  Description of Artificial Sequence: Synthetic polypeptide

SEQ ID NO: 9534 - protein, 486 aa, Artificial Sequence; identical to SEQ ID NO: 4591
  Description of Artificial Sequence: Synthetic polypeptide

SEQ ID NO: 9535 - protein, 486 aa, Artificial Sequence; identical to SEQ ID NO: 4592
  Description of Artificial Sequence: Synthetic polypeptide

SEQ ID NO: 9536 - protein, 491 aa, Artificial Sequence; identical to SEQ ID NO: 4593
  Description of Artificial Sequence: Synthetic polypeptide

SEQ ID NO: 9537 - protein, 491 aa, Artificial Sequence; identical to SEQ ID NO: 4594
  Description of Artificial Sequence: Synthetic polypeptide

SEQ ID NO: 9538 - protein, 491 aa, Artificial Sequence; identical to SEQ ID NO: 4595
  Description of Artificial Sequence: Synthetic polypeptide

SEQ ID NO: 9539 - protein, 491 aa, Artificial Sequence; identical to SEQ ID NO: 4596
  Description of Artificial Sequence: Synthetic polypeptide

SEQ ID NO: 9540 - protein, 491 aa, Artificial Sequence; identical to SEQ ID NO: 4597
  Description of Artificial Sequence: Synthetic polypeptide

SEQ ID NO: 9541 - protein, 242 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9542 - protein, 491 aa, Artificial Sequence; identical to SEQ ID NO: 4597
  Description of Artificial Sequence: Synthetic polypeptide

SEQ ID NO: 9543 - protein, 491 aa, Artificial Sequence; identical to SEQ ID NO: 4599
  Description of Artificial Sequence: Synthetic polypeptide

SEQ ID NO: 9544 - protein, 486 aa, Artificial Sequence; identical to SEQ ID NO: 4600
  Description of Artificial Sequence: Synthetic polypeptide

SEQ ID NO: 9545 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSS

SEQ ID NO: 9546 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSS

SEQ ID NO: 9547 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9548 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 9549 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 9550 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 9551 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 9552 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSHHHHHHHH

SEQ ID NO: 9553 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHHHH

SEQ ID NO: 9554 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYSSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 9555 - protein, 247 aa, Artificial Sequence
  Description of Artificial Sequence: Synthetic polypeptide
QVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIK

SEQ ID NO: 9556 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 9557 - protein, 276 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 9558 - protein, 276 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 9559 - protein, 271 aa, Artificial Sequence
  Description of Artificial Sequence: Synthetic polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHHHH

SEQ ID NO: 9560 - protein, 271 aa, Artificial Sequence
  Description of Artificial Sequence: Synthetic polypeptide
MALPVTALLLPLALLLHAARPQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGGSGGGGSGGGGSEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKHHHHHHHH

SEQ ID NO: 9561 - protein, 247 aa, Artificial Sequence
  Description of Artificial Sequence: Synthetic polypeptide
EIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSS

SEQ ID NO: 9562 - protein, 242 aa, Artificial Sequence; identical to SEQ ID NO: 9526
  Description of Artificial Sequence: Synthetic polypeptide

SEQ ID NO: 9563 - protein, 247 aa, Artificial Sequence; identical to SEQ ID NO: 9527
  Description of Artificial Sequence: Synthetic polypeptide

SEQ ID NO: 9564 - protein, 242 aa, Artificial Sequence; identical to SEQ ID NO: 9528
  Description of Artificial Sequence: Synthetic polypeptide

SEQ ID NO: 9565 - protein, 242 aa, Artificial Sequence; identical to SEQ ID NO: 9529
  Description of Artificial Sequence: Synthetic polypeptide

SEQ ID NO: 9566 - protein, 242 aa, Artificial Sequence; identical to SEQ ID NO: 9530
  Description of Artificial Sequence: Synthetic polypeptide

SEQ ID NO: 9567 - protein, 242 aa, Artificial Sequence; identical to SEQ ID NO: 9531
  Description of Artificial Sequence: Synthetic polypeptide

SEQ ID NO: 9568 - protein, 242 aa, Artificial Sequence; identical to SEQ ID NO: 9541
  Description of Artificial Sequence: Synthetic polypeptide

SEQ ID NO: 9569 - protein, 247 aa, Artificial Sequence; identical to SEQ ID NO: 9545
  Description of Artificial Sequence: Synthetic polypeptide

SEQ ID NO: 9570 - protein, 247 aa, Artificial Sequence; identical to SEQ ID NO: 9546
  Description of Artificial Sequence: Synthetic polypeptide

SEQ ID NO: 9571 - protein, 247 aa, Artificial Sequence; identical to SEQ ID NO: 9547
  Description of Artificial Sequence: Synthetic polypeptide

SEQ ID NO: 9572 - protein, 247 aa, Artificial Sequence; identical to SEQ ID NO: 9555
  Description of Artificial Sequence: Synthetic polypeptide

SEQ ID NO: 9573 - protein, 247 aa, Artificial Sequence; identical to SEQ ID NO: 9561
  Description of Artificial Sequence: Synthetic polypeptide

SEQ ID NO: 9574 - protein, 271 aa, Artificial Sequence
  Description of Artificial Sequence: Synthetic polypeptide
METDTLLLWVLLLWVPGSTGDIVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTSVTVSS

SEQ ID NO: 9575 - protein, 259 aa, Artificial Sequence
  Description of Artificial Sequence: Synthetic polypeptide
MVSTAQFLGLLLLWLTGGRCDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPELEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSS

SEQ ID NO: 9576 - protein, 272 aa, Artificial Sequence
  Description of Artificial Sequence: Synthetic polypeptide
MESHSQVFLSLLLWVSGTCGNIMMTQSPSSLAVSAGEKVTMNCKSSQSVFYSSNQRNYLAWYQQKPGQSPKLLIYWASTRESGVPDRFTGSGSGTDFTLTISSVHTEDLAVYYCHQFLSSWTFGGGTKLEIKGGGGSGGGGSGGGGSSQVQLQQPGAELVKPGTSVKLSCKASGYTFTNYWMVWVKQTPGEGLEWIGEIIPSNGRTKYNEKFKSKATLTADKSSRTAYMQLSSLASEDSAVYYCAREMSIITTVLTPGLLTGAKGLWSLSLQ

SEQ ID NO: 9577 - protein, 499 aa, Artificial Sequence; identical to SEQ ID NO: 4653
  Description of Artificial Sequence: Synthetic polypeptide

SEQ ID NO: 9578 - protein, 499 aa, Artificial Sequence; identical to SEQ ID NO: 4654
  Description of Artificial Sequence: Synthetic polypeptide

SEQ ID NO: 9579 - protein, 499 aa, Artificial Sequence; identical to SEQ ID NO: 4655
  Description of Artificial Sequence: Synthetic polypeptide

SEQ ID NO: 9580 - protein, 266 aa, Artificial Sequence; identical to SEQ ID NO: 5458
  Description of Artificial Sequence: Synthetic polypeptide

SEQ ID NO: 9581 - protein, 271 aa, Artificial Sequence; identical to SEQ ID NO: 9574
  Description of Artificial Sequence: Synthetic polypeptide

SEQ ID NO: 9582 - protein, 259 aa, Artificial Sequence; identical to SEQ ID NO: 9575
  Description of Artificial Sequence: Synthetic polypeptide

SEQ ID NO: 9583 - protein, 272 aa, Artificial Sequence; identical to SEQ ID NO: 9576
  Description of Artificial Sequence: Synthetic polypeptide

SEQ ID NO: 9584 - protein, 867 aa, Artificial Sequence [sequence omitted]

SEQ ID NO: 9585 - protein, 288 aa, Artificial Sequence
  Description of Artificial Sequence: Synthetic polypeptide
MKYLLPTAAAGLLLLAAQPAMAQVQLVQSGAEVKKPGSSVKVSCKASGYTFTDFYINWVRQAPGQGLEWIGEIYPYSGHAYYNEKFKARVTITADKSTSTAYMELSSLRSEDTAVYYCARWDFLDYWGQGTTVTVSSGGGGSGGGGSGGSAQDIVMTQSPLSLPVTPGEPASISCRSSQSLLHSNGNTYLHWYLQKPGQSPQLLIYTVSNRFSGVPDRFSGSGSGTDFTLKISRVEAEDVGVYYCSQSTHVPYTFGGGTKVEIKRAAAEQKLISEEDLNGAAHHHHHH

SEQ ID NO: 9586 - protein, 253 aa, Artificial Sequence
  Description of Artificial Sequence: Synthetic polypeptide
EIVMTQSPSTLSASVGDRVIITCQASQSISDWLAWYQQKPGKAPKLLIYGASRLASGFPSRFSGSGSGAEFTLTISSLQPDDFATYYCQQGWSDSYVDNLFGQGTKLTVLGGGGGSGGGGSGGGGSGGGGSEVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 9587 - protein, 253 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLQPADFATYYCQQGWSDSYVDNLFGQGTKLTVLGGGGGSGGGGSGGGGSGGGGSEVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 9588 - protein, 253 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLEPDDFATYYCQQGWSDSYVDNLFGQGTKLTVLGGGGGSGGGGSGGGGSGGGGSEVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 9589 - protein, 253 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGAEFTLTISSLQPDDFATYYCAGYYRSGSGTANGSFGQGTKLTVLGGGGGSGGGGSGGGGSGGGGSEVQLVESGGGLVQPGGSLRLSCAASGFTFSNDAISWVRQAPGKGLEWVSYISDWSIRYYANWAQGRFTISRDNSKNTLYLQMNSLRAEDTAVYYCAKGAPGAGDNGIWGQGTLVTVSS

SEQ ID NO: 9590 - protein, 253 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGTEFTLTISSLQPDDFATYYCAGYYRSGSGTANGSFGQGTKLTVLGGGGGSGGGGSGGGGSGGGGSEVQLVESGGGSVQPGGSLRLSCTVSGIDLSNDAISWVRQAPGKGLEWVAYISDWSIRYYANWAQGRFTISKDTSKNTVYLQMNSLRAEDTATYYCARGAPGAGDNGIWGQGTTVTVSS

SEQ ID NO: 9591 - protein, 253 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGAEFTLTISSLQPDDFATYYCAGYYRSGSGTANGSFGQGTKLTVLGGGGGSGGGGSGGGGSGGGGSEVQLVESGGGSVQPGGSLRLSCTVSGIDLSNDAISWVRQAPGKGLEWVAYISDWSIRYYANWAQGRFTISKDTSKNTVYLQMNSLRAEDTATYYCARGAPGAGDNGIWGQGTTVTVSS

SEQ ID NO: 9592 - protein, 252 aa, Artificial Sequence
  Description of Artificial Sequence: Synthetic polypeptide
EIVMTQSPSTLSASVGDRVIITCQASESIYSGLAWYQQKPGKAPKLLIYQASTLASGVPSRFSGSGSGAEFTLTISSLQPDDFATYYCQQGFGTSNVENPFGQGTKLTVLGGGGGSGGGGSGGGGSGGGGSEVQLVESGGGLVQPGGSLRLSCAASGFSLSRYGVSWVRQAPGKGLEWVSTIGEAGRAYYANWARSRFTISRDNSKNTLYLQMNSLRAEDTAVYYCAKGEVFNNGWGAFNIWGQGTLVTVSS

SEQ ID NO: 9593 - protein, 252 aa, Artificial Sequence
  Description of Artificial Sequence: Synthetic polypeptide
EIVMTQSPSTLSASVGDRVIITCQASESIYSGLAWYQQKPGKAPKLLIYQASTLASGVPSRFSGSGSGTDFTLAISSLQPDDFATYYCQQGFGTSNVENPFGQGTKLTVLGGGGGSGGGGSGGGGSGGGGSEVQLVESGGGLVQPGGSLRLSCTVSGFSLSRYGVSWVRQAPGKGLEWVGTIGEAGRAYYANWARSRSTISRDTSKNTVYLQMNSLRAEDTAVYYCARGEVFNNGWGAFNIWGQGTLVTVSS

SEQ ID NO: 9594 - protein, 252 aa, Artificial Sequence
  Description of Artificial Sequence: Synthetic polypeptide
EIVMTQSPSTLSASVGDRVIITCQASESIYSGLAWYQQKPGKAPKLLIYQASTLASGVPSRFSGSGSGAEFTLTISSLQPDDFATYYCQQGFGTSNVENPFGQGTKLTVLGGGGGSGGGGSGGGGSGGGGSEVQLVESGGGLVQPGGSLRLSCTVSGFSLSRYGVSWVRQAPGKGLEWVGTIGEAGRAYYANWARSRSTISRDTSKNTVYLQMNSLRAEDTAVYYCARGEVFNNGWGAFNIWGQGTLVTVSS

SEQ ID NO: 9595 - protein, 252 aa, Artificial Sequence
  Description of Artificial Sequence: Synthetic polypeptide
EIVMTQSPSTLSASVGDRVIITCQASENIYTSLAWYQQKPGKAPKLLIYSASTLASGVPSRFSGSGSGAEFTLTISSLQPDDFATYYCQQGFATSNVENPFGQGTKLTVLGGGGGSGGGGSGGGGSGGGGSEVQLVESGGGLVQPGGSLRLSCAASGFTFSRYGVSWVRQAPGKGLEWVSAIGETGRAYYANWAKSRFTISRDNSKNTLYLQMNSLRAEDTAVYYCAKGEEFNNGWGAFNIWGQGTLVTVSS

SEQ ID NO: 9596 - protein, 252 aa, Artificial Sequence
  Description of Artificial Sequence: Synthetic polypeptide
EIVMTQSPSTLSASVGDRVIITCQASENIYTSLAWYQQKPGKAPKLLIYSASTLASGVPSRFSGSGSGTEFTLTISSLQPDDFATYYCQQGFATSNVENPFGQGTKLTVLGGGGGSGGGGSGGGGSGGGGSEVQLVESGGGSVQPGGSLRLSCTVSGFSLSRYGVSWVRQAPGKGLEWVGAIGETGRAYYANWAKSRSTISRDTSKNTVYLQMNSLRAEDTATYYCARGEEFNNGWGAFNIWGQGTTVTVSS

SEQ ID NO: 9597 - protein, 252 aa, Artificial Sequence
  Description of Artificial Sequence: Synthetic polypeptide
EIVMTQSPSTLSASVGDRVIITCQASENIYTSLAWYQQKPGKAPKLLIYSASTLASGVPSRFSGSGSGAEFTLTISSLQPDDFATYYCQQGFATSNVENPFGQGTKLTVLGGGGGSGGGGSGGGGSGGGGSEVQLVESGGGSVQPGGSLRLSCTVSGFSLSRYGVSWVRQAPGKGLEWVGAIGETGRAYYANWAKSRSTISRDTSKNTVYLQMNSLRAEDTATYYCARGEEFNNGWGAFNIWGQGTTVTVSS

SEQ ID NO: 9598 - protein, 252 aa, Artificial Sequence
  Description of Artificial Sequence: Synthetic polypeptide
EIVMTQSPSTLSASVGDRVIITCQASDNIYRGLAWYQQKPGKAPKLLIYDASTLQSGVPSRFSGSGSGAEFTLTISSLQPDDFATYYCLGVYGYSSDDGAAFGQGTKLTVLGGGGGSGGGGSGGGGSGGGGSEVQLVESGGGLVQPGGSLRLSCAASGFSLNSNEISWVRQAPGKGLEWVSYIGNGGMTHYASWAKGRFTISRDNSKNTLYLQMNSLRAEDTAVYYCAKSVEYTDLYYLNIWGQGTLVTVSS

SEQ ID NO: 9599 - protein, 252 aa, Artificial Sequence
  Description of Artificial Sequence: Synthetic polypeptide
EIVMTQSPSTLSASVGDRVIITCQASDNIYRGLAWYQQKPGKAPKLLIYDASTLQSGVPSRFSGSGSGTQFTLTISSLQPDDFATYYCLGVYGYSSDDGAAFGQGTKLTVLGGGGGSGGGGSGGGGSGGGGSEVQLVESGGGLVQPGGSLRLSCTVSGFSLNSNEISWVRQAPGKGLEWVGYIGNGGMTHYASWAKGRFTISRDTSKNTVYLQMNSLRAEDTAVYYCASSVEYTDLYYLNIWGQGTLVTVSS

SEQ ID NO: 9600 - protein, 253 aa, Artificial Sequence
  Description of Artificial Sequence: Synthetic polypeptide
EIVMTQSPSTLSASVGDRVIITCQSSQSVYGNIWMAWYQQKPGKAPKLLIYQASKLASGVPSRFSGSGSGAEFTLTISSLQPDDFATYYCQGNFNTGDRYAFGQGTKLTVLGGGGGSGGGGSGGGGSGGGGSEVQLVESGGGLVQPGGSLRLSCAASGFTISRSYWICWVRQAPGKGLEWVSCIYGDNDITPLYANWAKGRFTISRDNSKNTLYLQMNSLRAEDTAVYYCAKLGYADYAYDLWGQGTLVTVSS

SEQ ID NO: 9601 - protein, 253 aa, Artificial Sequence
  Description of Artificial Sequence: Synthetic polypeptide
EIVMTQSPSTLSASLGDRVIITCQSSQSVYGNIWMAWYQQKSGKAPKLLIYQASKLASGVPSRFSGSGSGAEFSLTISSLQPDDFATYYCQGNFNTGDRYAFGQGTKLTVLGGGGGSGGGGSGGGGSGGGGSEVQLVESGGGLVQPGGSLRLSCTASGFTISRSYWICWVRQAPGKGLEWVACIYGDNDITPLYANWAKGRFPVSTDTSKNTVYLQMNSLRAEDTAVYYCARLGYADYAYDLWGQGTLVTVSS

SEQ ID NO: 9602 - protein, 253 aa, Artificial Sequence
  Description of Artificial Sequence: Synthetic polypeptide
EIVMTQSPSTLSASVGDRVIITCQASQSISNLLAWYQQKPGKAPKLLIYAASKLASGVPSRFSGSGSGAEFTLTISSLQPDDFATYYCQQGWSHTNVDNTFGQGTKLTVLGGGGGSGGGGSGGGGSGGGGSEVQLVESGGGLVQPGGSLRLSCAASGFTFSVGYWICWVRQAPGKGLEWVSCIDAGTSGGTYYATWAKGRFTISRDNSKNTLYLQMNSLRAEDTAVYYCAKGVSSNGYYFKLWGQGTLVTVSS

SEQ ID NO: 9603 - protein, 253 aa, Artificial Sequence
  Description of Artificial Sequence: Synthetic polypeptide
EIVMTQSPSTLSASVGDRVIITCQASQSISNLLAWYQQKPGKAPKLLIVAASKLASGVPSRFSGSGSGTEFTLTISSLQPDDFATYYCQQGWSHTNVDNTFGQGTKLTVLGGGGGSGGGGSGGGGSGGGGSEVQLVESGGGSVQPGGSLRLSCTASGFSFSVGYWICWVRQAPGKGLEWVACIDAGTSGGTYYATWAKGRFTISKDTSKNTVYLQMNSLRAEDTATYYCARGVSSNGYYFKLWGQGTTVTVSS

SEQ ID NO: 9604 - protein, 253 aa, Artificial Sequence
  Description of Artificial Sequence: Synthetic polypeptide
EIVMTQSPSTLSASVGDRVIITCQASQSISNLLAWYQQKPGKAPKLLIYAASKLASGVPSRFSGSGSGAEFTLTISSLQPDDFATYYCQQGWSHTNVDNTFGQGTKLTVLGGGGGSGGGGSGGGGSGGGGSEVQLVESGGGSVQPGGSLRLSCTASGFSFSVGYWICWVRQAPGKGLEWVACIDAGTSGGTYYATWAKGRFTISKDTSKNTVYLQMNSLRAEDTATYYCARGVSSNGYYFKLWGQGTTVTVSS

SEQ ID NO: 9605 - protein, 253 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGAEFTLTISSLQPDDFATYYCAGYYRSGFGTANGSFGQGTKLTVLGGGGGSGGGGSGGGGSGGGGSEVQLVESGGGLVQPGGSLRLSCAASGFTFRNDAISWVRQAPGKGLEWVSYISDWGIKYYASWVKGRFTISRDNSKNTLYLQMNSLRAEDTAVYYCAKGAPGAGDNGIWGQGTLVTVSS

SEQ ID NO: 9606 - protein, 253 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGTEFTLTISSLQPDDFATYYCAGYYRSGFGTANGSFGQGTKLTVLGGGGGSGGGGSGGGGSGGGGSEVQLVESGGGSVQPGGSLRLSCTVSGIDLRNDAISWVRQAPGKGLEWVSYISDWGIKYYASWVKGRFTISKDTSKNTVYLQMNSLRAEDTATYYCARGAPGAGDNGIWGQGTTVTVSS

SEQ ID NO: 9607 - protein, 253 aa, Artificial Sequence
  Description of Artificial Sequence: Synthetic polypeptide
EIVMTQSPSTLSASVGDRVIITCQSTESVYKNNYLAWYQQKPGKAPKLLIYDASTLASGVPSRFSGSGSGAEFTLTISSLQPDDFATYYCAGYYRSGFGTANGSFGQGTKLTVLGGGGGSGGGGSGGGGSGGGGSEVQLVESGGGSVQPGGSLRLSCTVSGIDLRNDAISWVRQAPGKGLEWVSYISDWGIKYYASWVKGRFTISKDTSKNTVYLQMNSLRAEDTATYYCARGAPGAGDNGIWGQGTTVTVSS

SEQ ID NO: 9608 - protein, 253 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLQPDDFATYYCQQGWSDSYVDNLFGQGTKLTVLGGGGGSGGGGSGGGGSGGGGSEVQLVESGGGLVQPGGSLRLSCAASGFSLSSGAMSWVRQAPGKGLEWVSVIISSGATYYASWAKGRFTISRDNSKNTLYLQMNSLRAEDTAVYYCAKGGPDDSNSMGTFDPWGQGTLVTVSS

SEQ ID NO: 9609 - protein, 253 aa, Artificial Sequence
  Description of Artificial Sequence: Synthetic polypeptide
EIVMTQSPSTLSASVGDRVIIKCQASQSISDWLAWYQQKPGKAPKLLIYGASRLASGFPSRFSGSGSGAEFTLTISGLEPADFATYYCQQGWSDSYVDNLFGQGTKLTVLGGGGGSGGGGSGGGGSGGGGSEVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 9610 - protein, 253 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLQPDDFATYYCQQGWSDSYVDNLFGQGTKLTVLGGGGGSGGGGSGGGGSGGGGSEVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 9611 - protein, 253 aa, Artificial Sequence
  Description of Artificial Sequence: Synthetic polypeptide
EIVMTQSPSTLSASVGDRVIIKCQASQSISDWLAWYQQKPGKAPKLLIYGASRLASGFPSRFSGSGSGAEFTLTISGLEPADFATYYCQQGWSDSYVDNLFGQGTKLTVLGGGGGSGGGGSGGGGSGGGGSEVQLVESGGGSVQPGGSLRLSCTVSGFSLSSGAMSWVRQAPGKGLEWVGVIISSGATYYASWAKGRFTISKDTSKNTVYLQMNSLRAEDTATYYCARGGPDDSNSMGTFDPWGQGTSVTVSS

SEQ ID NO: 9612 - protein, 253 aa, Artificial Sequence
  Description of Artificial Sequence: Synthetic polypeptide
EIVMTQSPSTLSASVGDRVIITCQASQSISDWLAWYQQKPGKAPKLLIYGASRLASGVPSRFSGSGSGAEFTLTISSLQPDDFATYYCQQGWSDSYVDNLFGQGTKLTVLGGGGGSGGGGSGGGGSGGGGSEVQLVESGGGSVQPGGSLRLSCTVSGFSLSSGAMSWVRQAPGKGLEWVGVIISSGATYYASWAKGRFTISKDTSKNTVYLQMNSLRAEDTATYYCARGGPDDSNSMGTFDPWGQGTSVTVSS

SEQ ID NO: 9613 - protein, 253 aa, Artificial Sequence
  Description of Artificial Sequence: Synthetic polypeptide
EIVMTQSPSTLSASVGDRVIIKCQASQSISDWLAWYQQKPGKAPKLLIYGASRLASGVPSRFSGSGSGAEFTLTISSLQPDDFATYYCQQGWSDSYVDNLFGQGTKLTVLGGGGGSGGGGSGGGGSGGGGSEVQLVESGGGLVQPGGSLRLSCTVSGFSLSSGAMSWVRQAPGKGLEWVGVIISSGATYYASWAKGRFTISKDTSKNTVYLQMNSLRAEDTAVYYCARGGPDDSNSMGTFDPWGQGTLVTVSS

SEQ ID NO: 9614 - protein, 232 aa, Artificial Sequence
  Description of Artificial Sequence: Synthetic polypeptide
QVQLVESGGGWQPGRSLRLDCKASGITFSNSGMHWVRQAPGKGLEWVAVIYDGSKRYYADSVKGRFISRDNSKNTLFLQMNSLRAEDTAVYYCATNDDYWGQGTLVTVSSGGGGSGGGGSGGGGSEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIK

SEQ ID NO: 9615 - protein, 414 aa, Artificial Sequence
  Description of Artificial Sequence: Synthetic polypeptide
METDTLLLWVLLLWVPGSTGDGLGLQVFFVALLKGVHCEVRLLESGGGLVPEGSLKLSCVASGFTFSDYFMSWVRQAPGKGLEWVAHIYTKSYNYATYYSGSVKGRFTISRDDSRSMVYLQMNNLRTEDTATYYCTRDGSGYPSLDFWGQGTQVTVSSATTTAPSVYPLAPACDSTTKSGGGGSGGGGSGGGGSYELTQPPSASVVGETVKITCSGDQLPKYFADWFHQRSDQTILQVIYDDNKRPSGIPERISGSSSGTTATLTIRDVRAEDEGDYYCFSGYVDSDSKLYVFGSGTQLTVLGGPSSPKVTVFPPSPEELRTNKATLVCLVNDFYPGSATVTWKANGATINDGVKTTPSKQGQNYMTSSYLSLTADQWSHNRVSCQVTHEGETVEKSLSPAECLEQKLISEEDL

SEQ ID NO: 9616 - protein, 249 aa, Artificial Sequence
  Description of Artificial Sequence: Synthetic polypeptide
EVQLVESGGDLVKPGGSLKLSCAASGFTFSGYGMSWVRQTPDKRLEWVATITSGGTYTYYPDSVKGRFTISRDNAKNTLYLQIDSLKSEDTAIYFCARSLAGNAMDYWGQGTSVTVSSGGGGSGGGGSGGGGSDIVMTQSPATLSVTPGDRVSLSCRASQTISDYLHWYQQKSHESPRLLIKFASQSISGIPSRFSGSGSGSDFTLSINSVEPEDVGVYYCQNGHGFPRTFGGGTKLEIKEQLISEEDL

SEQ ID NO: 9617 - protein, 245 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGTHNRKIWGQGTMVTVSSAPQAKSSGSGSESKVDQAVVTQEPSLTVSPGGTVTLTCASSTGAVTSGNYPNWFQQRPGQPPRALIYSTSNKHSWTPARFSGSLLGGKAALTLSGAQPEDEAEYYCRLSYDLARPVFGGGTKLTVLG

SEQ ID NO: 9618 - protein, 245 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLVHRYRAIWGQGTMVTVSSAPQAKSSGSGSESKVDQAVVTQEPSLTVSPGGTVTLTCASSTGAVTSGNYPNWFQQRPGQPPRALIYSTSNKHSWTPARFSGSLLGGKAALTLSGAQPEDEAEYYCRLSYDLARPVFGGGTKLTVLG

SEQ ID NO: 9619 - protein, 245 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARPYATDTRIWGQGTMVTVSSAPQAKSSGSGSESKVDQAVVTQEPSLTVSPGGTVTLTCASSTGAVTSGNYPNWFQQRPGQPPRALIYSTSNKHSWTPARFSGSLLGGKAALTLSGAQPEDEAEYYCRLSYDLARPVFGGGTKLTVLG

SEQ ID NO: 9620 - protein, 216 aa, Artificial Sequence
  Description of Artificial Sequence: Synthetic polypeptide
QAVVTQEPSLTVSPGGTVTLTCASSTGAVTSGNYPNWFQQRPGQPPRALIYSTSNKHSWTPARFSGSLLGGKAALTLSGAQPEDEAEYYCRLSYDLARPVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 9621 - protein, 221 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQGTHNRKIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 9622 - protein, 216 aa, Artificial Sequence; identical to SEQ ID NO: 9620
  Description of Artificial Sequence: Synthetic polypeptide

SEQ ID NO: 9623 - protein, 221 aa, Artificial Sequence
  Description of Artificial Sequence: Synthetic polypeptide
QQVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLVHRYRAIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 9624 - protein, 216 aa, Artificial Sequence; identical to SEQ ID NO: 9620
  Description of Artificial Sequence: Synthetic polypeptide

SEQ ID NO: 9625 - protein, 647 aa, Artificial Sequence
  Description of Artificial Sequence: Synthetic polypeptide
HHHHHHDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRATPSHNSHQVPSAGGPTANSGTSGSEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSEFGGAPEFPKPSTPPGSSGLEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPHHHHHHKDEL

SEQ ID NO: 9626 - protein, 235 aa, Artificial Sequence
  Description of Artificial Sequence: Synthetic polypeptide
EVQLQQSGAELVKPGASVKLSCTASGFNIKDYYIHWVQQRTEQGLEWIGRIDPEDGETKYAPKFQDKATITADTSSNTAYLHLSSLTSEDTAVYYCARWGAYWGQGTLVTVSGGGGSGGGGSGGGGSQIVLTQSPAIMSASPGEKVTLTCSASSSVSSSYLYWYQQKPGSSPKLWIYSTSNLASGVPARFSGSGSGTSYSLTISSMEAEDAASYFCHQWSSYPRTFGAGTKLELK

SEQ ID NO: 9627 - protein, 249 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGPRYYDILTGYRYNWFDPWGRGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 9628 - protein, 251 aa, Artificial Sequence
  Description of Artificial Sequence: Synthetic polypeptide
QLQLQESGPGLVKPSETLSLTCTVSGGFISSRTSYWGWIRQPPGKGPEWIGNIYYTGKTYYSPSLKSRVTISVDTSKNQLSLKLNSVTAADTAVYYCARAGYDLLTGYPFYFDSWGKGTLVTVSSGGGGSGGGGSGGGGSALEIVLTQSPATLSLSPGERATLSCRASQSVSSYLAWYQQKPGQAPRLLIYDASNRATGIPARFSGSGSGTDFTLTISSLEPEDFAVYYCQQRSNWPFLTFGGGTKVEIKR

SEQ ID NO: 9629 - protein, 249 aa, Artificial Sequence
  Description of Artificial Sequence: Synthetic polypeptide
QVQLQQSGAEVKKPGSSVRVSCKASGGTFNNNAINWVRQAPGQGLEWMGGIIPMFGTAKYSQNFQGRVAITADESTGTASMELSSLRSEDTAVYYCARSRDLLLFPHHALSPWGRGTMVTVSSGGGGSGGGGSGGGGSAFSSELTQDPAVSVALGQTVRVTCQGDSLRSYYASWYQQKPGQAPVLVIYGKNNRPSGIPDRFSGSSSGNTASLTITGAQAEDEADYYCSSRDSSGNHWVFGGGTELTVLG

SEQ ID NO: 9630 - protein, 272 aa, Artificial Sequence
  Description of Artificial Sequence: Synthetic polypeptide
HHHHHHVKLQESGAELVKPGASVKLSCKASGYTFTSYWMHWVKQRPGRGLEWIGRIGPNSGGTKYNEKFKSKATLTVDKPSSTAYMQLSSLTSEDSAVYYCARRMVKGCYGLLGPRDHGHRLLKGRIPAHWRPLLVDPSSVPSLASGGGGGSGGGGSWISAEFALDIELTQSPTTMAASPGEKITITCSASSSISSNYLHWYQQKPGFSPKLLIYRTSNLASGVPARFSGSGSGTSYSLTIGTMEAEDVATYYCQQGSSIPRTRSEGAPSWK

SEQ ID NO: 9631 - protein, 274 aa, Artificial Sequence
  Description of Artificial Sequence: Synthetic polypeptide
MSVPTQVLGLLLLWLTDARCVKLQESGPELVKPGASVKISCKASGYTFTDYYMNWVKQSHGKSLEWIGDINPNNGGTSYNQKFKGKATLTVDKSSSTAYMELRSLTSEDSAVYYCARYDYAWYFDVWGQGTTVTVSSGGGGSGGGGSGGGGDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIKRIEGRHHHHHH

SEQ ID NO: 9632 - protein, 275 aa, Artificial Sequence
  Description of Artificial Sequence: Synthetic polypeptide
VKLQESGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTVTVSSRANSADIHHTGGRSSMHLEGPIRPIVSRISGGGGGSGGGGSWISAEFALDIVMTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 9633 - protein, 271 aa, Artificial Sequence
  Description of Artificial Sequence: Synthetic polypeptide
MSVPTQVLGLLLLWLTDARCVKLQESGTELVKPGASVKLSCKASGYTFTSYWMHWVKQRPGQGLEWIGNINPSNGGTNYNEKFKSKATLTVDKSSSTAYMQLSSLTSEDSAVYYCARRGIRLRHFDYWGQGTTVTVSSGGGGSGGGGSGGGGSDIQMTQSPKFMSTSVGDRVSITCKASQDVGTAVAWYQQKPGQSPKLLIYWASTRHTGVPDRFTGSGSGTDFTLTISNVQSEDLADYFCQQYSSYPLTFGAGTKLELKRIEGRHHHHHH

SEQ ID NO: 9634 - protein, 245 aa, Artificial Sequence
  Description of Artificial Sequence: Synthetic polypeptide
QVQLVQSGAEVKKPGASVKVSCKASGYTFSMYWLEWVRQAPGHGLEWVGEISPGTFTTNYNEKFKARATFTADTSTNTAYMELSSLRSEDTAVYYCARFSHFSGSNYDYFDYWGQGTLVTVSSGGGGSGGGGSGGGGSDILLTQSPGTLSLSPGERATLSCRASQSIGTNIHWYQQKPGQAPRLLIKYASESISGIPSRFSGSGSGTDFTLTISRLEPEDFAMYYCQQSDSWPTTFGQGTKVEIK

SEQ ID NO: 9635 - protein, 242 aa, Artificial Sequence; identical to SEQ ID NO: 9526
  Description of Artificial Sequence: Synthetic polypeptide

SEQ ID NO: 9636 - protein, 247 aa, Artificial Sequence; identical to SEQ ID NO: 9527
  Description of Artificial Sequence: Synthetic polypeptide

SEQ ID NO: 9637 - protein, 242 aa, Artificial Sequence; identical to SEQ ID NO: 9528
  Description of Artificial Sequence: Synthetic polypeptide

SEQ ID NO: 9638 - protein, 242 aa, Artificial Sequence; identical to SEQ ID NO: 9529
  Description of Artificial Sequence: Synthetic polypeptide

SEQ ID NO: 9639 - protein, 242 aa, Artificial Sequence; identical to SEQ ID NO: 9530
  Description of Artificial Sequence: Synthetic polypeptide

SEQ ID NO: 9640 - protein, 242 aa, Artificial Sequence; identical to SEQ ID NO: 9531
  Description of Artificial Sequence: Synthetic polypeptide

SEQ ID NO: 9641 - protein, 242 aa, Artificial Sequence; identical to SEQ ID NO: 9541
  Description of Artificial Sequence: Synthetic polypeptide

SEQ ID NO: 9642 - protein, 247 aa, Artificial Sequence; identical to SEQ ID NO: 9545
  Description of Artificial Sequence: Synthetic polypeptide

SEQ ID NO: 9643 - protein, 242 aa, Artificial Sequence
  Description of Artificial Sequence: Synthetic polypeptide
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 9644 - protein, 247 aa, Artificial Sequence; identical to SEQ ID NO: 9546
  Description of Artificial Sequence: Synthetic polypeptide

SEQ ID NO: 9645 - protein, 247 aa, Artificial Sequence; identical to SEQ ID NO: 9547
  Description of Artificial Sequence: Synthetic polypeptide

SEQ ID NO: 9646 - protein, 247 aa, Artificial Sequence; identical to SEQ ID NO: 9555
  Description of Artificial Sequence: Synthetic polypeptide

SEQ ID NO: 9647 - protein, 247 aa, Artificial Sequence; identical to SEQ ID NO: 9561
  Description of Artificial Sequence: Synthetic polypeptide

SEQ ID NO: 9648 - protein, 357 aa, Artificial Sequence
  Description of Artificial Sequence: Synthetic polypeptide
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVSSGDGSSGGSGGASEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSGGSGGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPESSRRGGC

SEQ ID NO: 9649 - protein, 233 aa, Artificial Sequence
  Description of Artificial Sequence: Synthetic polypeptide
SEKSEEINEKDLRKKSELQGTALGNLKQIYYYNSKAITSSEKSADQFLTNTLLFKGFFTGHPWYNDLLVDLGSTAATSEYEGSSVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNTTISSTSLSISLYLYTT

SEQ ID NO: 9650 - protein, 246 aa, Artificial Sequence
  Description of Artificial Sequence: Synthetic polypeptide
LESGAELVRPGSSVKISCKASGYAFSSYWMNWVKQRPGQGLEWIGQIWPGDGDTNYNGKFKGKATLTADESSSTAYMQLSSLRSEDSAVYSCARRETTTVGRYYYAMDYWGQGTTVTGGGGSGGGGSGGGGSELVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRRS

SEQ ID NO: 9651 - protein, 241 aa, Artificial Sequence
  Description of Artificial Sequence: Synthetic polypeptide
LESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDNWGQGTTVTGGGGSGGGGSGGGGSELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRS

SEQ ID NO: 9652 - protein, 243 aa, Artificial Sequence
  Description of Artificial Sequence: Synthetic polypeptide
LESGAELVRPGASVKISCKASGYAFSSSWMNWVKQRPGQGLEWIGRIYPGDGDTNYNGKFKEAATLTADKSSSTAYMQLSSLTSVDSAVYSCARSEYWGNYWAMDYWGQGTTVTGGGGSGGGGSGGGGSELVLTQSPASLAVSLGQRATISCRASQSVDNYGISFMNWFQQKPGQPPKLLIYAASNQGSGVPARFSGSGSGTDFSLNIHPMEEDDTAMYFCQQSKEVPRTFGGGTKLEIKRRS

SEQ ID NO: 9653 - protein, 247 aa, Artificial Sequence
  Description of Artificial Sequence: Synthetic polypeptide
LESGAELVRPGSSVKISCKASGYAFSSYWMNWVKQRPGQGLEWIGQIWPGDGDTNYNGKFKGKATLTADESSSTAYMQLSSLRSEDSAVYSCARRETTTVGRYYYAMDYWGQGTTVTGGGGSGGGGSGGGGSELVLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKRRSC

SEQ ID NO: 9654 - protein, 242 aa, Artificial Sequence
  Description of Artificial Sequence: Synthetic polypeptide
LESGAELVRPGSSVKISCKASGYAFSSYWMNWVKQRPGQGLEWIGQIYPGDGDTNYNGKFKGQATLTADKSSSTAYMQLSGLTSEDSAVYSCARKTISSVVDFYFDNWGQGTTVTGGGGSGGGGSGGGGSELVLTQSPKFMSTSVGDRVSVTCKASQNVGTNVAWYQQKPGQSPKPLIYSATYRNSGVPDRFTGSGSGTDFTLTITNVQSKDLADYFYFCQYNRYPYTSGGGTKLEIKRRSC

SEQ ID NO: 9655 - protein, 116 aa, Artificial Sequence
  Description of Artificial Sequence: Synthetic polypeptide
EVQLLESGGGLVQPGGSLRLSCAASGFTFSQYRMWWVRQAPGKGLEWVSAIAPSGDNTYYADSVKGRFTISRDNSKNTLYLQMNSLRAEDTAVYYCAKHRTSFDYWGQGTLVTVSS

SEQ ID NO: 9656 - protein, 122 aa, Artificial Sequence
  Description of Artificial Sequence: Synthetic polypeptide
EVQLLESGGGLVQPGGSLRLSCAASGFTFGTEQMWWVRQAPGKGLEWVSRIDSPGGRTYYADSVKGRFTISRDNSKNTLYLQMNSLRAEDTAVYYCAKRHAAGVSGTYFDYWGQGTLVTVSS

SEQ ID NO: 9657 - protein, 116 aa, Artificial Sequence
  Description of Artificial Sequence: Synthetic polypeptide
EVQLLESGGGLVQPGGSLRLSCAASGFTFTDDRMWWVRQAPGKGLEWVSAIDPQGQHTYYADSVKGRFTISRDNSKNTLYLQMNSLRAEDTAVYYCAKELLSFDYWGQGTLVTVSS

SEQ ID NO: 9658 - protein, 124 aa, Artificial Sequence
  Description of Artificial Sequence: Synthetic polypeptide
EVQLLESGGGLVQPGGSLRLSCAASGFTFFNYEMAWARQAPGKGLEWVSLISAEGTRTYYANSVKGRFTISRDNSKNTLYLQMNSLRAEDTAVYYCAKRRDASMGHTTRRFDHWGQGTLVTVSS

SEQ ID NO: 9659 - protein, 124 aa, Artificial Sequence
  Description of Artificial Sequence: Synthetic polypeptide
EVQLLESGGGLVQPGGSLRLSCAASGFTFFNYEMAWARRAPGKGLEWVSLISADGTRTYYANSVRGRFTISRDNSKNTLYLQMNSLRAEDTAVYYCAKRRDASMGHTTRRFDYSGQGTLVTVSS

SEQ ID NO: 9660 - protein, 124 aa, Artificial Sequence
  Description of Artificial Sequence: Synthetic polypeptide
EVQLLESGGGLVQPGGSLRLSCTASGFTFTEYRMWWVRQAPGKGLEWVSLIEPIGNRTYYADSVKGRFTISRDNSKNTLYLQMNSLRAEDTAVYYCAKQIPGHMWTANPRSDYWGQGTQVTVSS

SEQ ID NO: 9661 - protein, 124 aa, Artificial Sequence
  Description of Artificial Sequence: Synthetic polypeptide
EVQLLESGGGLVQPGGSLRLSCAASGFTFTEYRMWWVRQAPGKGLEWVSAIEPIGNRTYYADSVKGRFTISRDNSKNTLYLQMNSLRAEDTAVYYCAKQIPGRKWTANSRFDYWGQGTLVTVSS

SEQ ID NO: 9662 - protein, 124 aa, Artificial Sequence
  Description of Artificial Sequence: Synthetic polypeptide
EVQLLESGGGLVQPGGSLRLSCTASGFTFTEYRMWWVRQAPGKGLEWVSLIEPIGNRTYYANSVRGRFTISRDNSKNTLYLQMNSLRAEDTAVYYCAKQIPGHMWTANPRSDYWGQGTQVTVSS

SEQ ID NO: 9663 - protein, 124 aa, Artificial Sequence
  Description of Artificial Sequence: Synthetic polypeptide
EVQLLESGGGLVQPGGSLRLSCAASGFTFTEYRMWWVRQAPGKGLEWVSAIEPIGNRTYYANSVRGRFTISRDNSKNTLYLQMNSLRAEDTAVYYCAKQIPGRKWTANSRFDYWGQGTLVTVSS

SEQ ID NO: 9664 - protein, 116 aa, Artificial Sequence
  Description of Artificial Sequence: Synthetic polypeptide
EVQLLESGGGLVQPGGSLRLSCAASGFTISDYRMWWVRQAPGKGLEWVSAIDSQGHTTYYADSVRGRFTISRDNSKNTLYLQMNSLRAEDTAVYYCAKYGGYFDYWGQGTLVTVSS

SEQ ID NO: 9665 - protein, 116 aa, Artificial Sequence
  Description of Artificial Sequence: Synthetic polypeptide
EVQLLESGGGLVQPGGSLRLSCATSGFTFSDYRMWWVRQAPGKGLEWVSAIDSQGHTTYYADSVKGRFTISRDNSKNTLYLQMNSLRAEDTAVYYCAKYGGYFDYWGQGTLVTVSS

SEQ ID NO: 9666 - protein, 116 aa, Artificial Sequence
  Description of Artificial Sequence: Synthetic polypeptide
EVQLLESGGGLVQPGGSLRLSCAASGFTFSDYDMWWVRQAPGKGLEWVSKITQKGDFTYYADSVKGRFTISRDNSKNTLYLQMNSLRAEDTAVYYCAKDATHFDYWGQGTLVTVSS

SEQ ID NO: 9667 - protein, 116 aa, Artificial Sequence
  Description of Artificial Sequence: Synthetic polypeptide
EVQLLESGGGLVQPGGSLRLSCAASGFTISDYRMWWVRQAPGKGLEWVSAIDSQGHTTYYANSVRGRFTISRDNSKNTLYLQMNSLRAEDTAVYYCAKYGGYFDYWGQGTLVTVSS

SEQ ID NO: 9668 - protein, 116 aa, Artificial Sequence
  Description of Artificial Sequence: Synthetic polypeptide
EVQLLESGGGLVQPGGSLRLSCATSGFTFSDYRMWWVRQAPGKGLEWVSAIDSQGHTTYYANSVRGRFTISRDNSKNTLYLQMNSLRAEDTAVYYCAKYGGYFDYWGQGTLVTVSS

SEQ ID NO: 9669 - protein, 122 aa, Artificial Sequence
  Description of Artificial Sequence: Synthetic polypeptide
EVQLLESGGGLVRPGGSLRLSCAASGFTFGTEQMWWVRQAPGKGLEWVSRIDSPGGRTYYADSVRGRFTISRDNSKNTLYLQMNSLRAEDTAVYYCAKRHAAGVSGTYFDYWGQGTLVTVSS

SEQ ID NO: 9670 - protein, 122 aa, Artificial Sequence
  Description of Artificial Sequence: Synthetic polypeptide
EVQLLESGGGLVRPGGSLRLSCAASGFTFGTEQMWWVRQAPGKGLEWVSRIDSPGGRTYYANSVRGRFTISRDNSKNTLYLQMNSLRAEDTAVYYCAKRHAAGVSGTYFDYWGQGTLVTVSS

SEQ ID NO: 9671 - protein, 124 aa, Artificial Sequence
  Description of Artificial Sequence: Synthetic polypeptide
EVQLLESGGGLVQPGGSLRLSCAASGFTFFNYEMAWARQAPGKGLEWVSLISAEGTRTYYADSVKGRFTISRDNSKNTLYLQMNSLRAEDTAVYYCAKRRDASMGHTTRRFDYWGQGTLVTVSS

SEQ ID NO: 9672 - protein, 124 aa, Artificial Sequence
  Description of Artificial Sequence: Synthetic polypeptide
EVQLLESGGGLVQPGGSLRLSCAASGFTFTEYRMWWVRQAPGKGLEWVSSIEPIGNRTYYADSVKGRFTISRDNSKNTLYLQMNSLRAEDTAVYYCAKQIPGHKWTANSRFDYWGQGTLVTVSS

SEQ ID NO: 9673 - protein, 121 aa, Artificial Sequence
  Description of Artificial Sequence: Synthetic polypeptide
EVQLLESGGGLVQPGGSLRLSCAASGFTFSDYDMAWARQAPGKGLEWVSRISHSGYSTYYADSVKGRFTISRDNSKNTLYLQMNSLRAEDTAVYYCAKRSWDGVHAQFDYWGQGTLVTVSS

SEQ ID NO: 9674 - protein, 116 aa, Artificial Sequence
  Description of Artificial Sequence: Synthetic polypeptide
EVQLLESGGGLVQPGGSLRLTCAASGFTFTDDRMWWVRQAPGKGLEWVSAIDPQGQHTYYADSVKGRFTISRDNSKNTLYLQMNSLRAEDTAVYYCAKHNSSFDYWGQGTLVTVSS

SEQ ID NO: 9675 - protein, 116 aa, Artificial Sequence
  Description of Artificial Sequence: Synthetic polypeptide
EVQLLESGGGLVQPGGSLRLSCAASGFTFSDYKMGWVRQAPGKGLEWVSSIWPNGGLTYYADSVKGRFTISRDNSKNTLYLQMNSLRAEDTAVYYCAKDHMGFDYWGQGTLVTVSS

SEQ ID NO: 9676 - protein, 116 aa, Artificial Sequence
  Description of Artificial Sequence: Synthetic polypeptide
EVQLLESGGGLVQPGGSLRLSCAASGFTFSDYRMWWVRQAPGKGLEWVSAIDSQGHTTYYADSVKGRFTISRDNSKNTLYLQMNSLRAEDTAVYYCAKYGGYFDYWGQGTLVTVSS

SEQ ID NO: 9677 - protein, 119 aa, Artificial Sequence
  Description of Artificial Sequence: Synthetic polypeptide
EVQLLESGGGLVQPGGSLRLSCAASGFTFAQGDMWWVRQAPGKGLEWVSRIGMDGDKTYYADSVKGRFTISRDNSKNTLYLQMNSLRAEDTAVYYCAKGPSSTSPFDYWGQGTLVTVSS

SEQ ID NO: 9678 - protein, 493 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAESKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9679 - protein, 493 aa, Artificial Sequence
  Description of Artificial Sequence: Synthetic polypeptide
MEAPAQLLFLLLLWLPDTTGEIVLTQSPATLSLSPGERATLSCRTSQNVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9680 - protein, 493 aa, Artificial Sequence
  Description of Artificial Sequence: Synthetic polypeptide
MEAPAQLLFLLLLWLPDTTGEIVLTQSPATLSLSPGERATLSCRTSESVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9681 - protein, 493 aa, Artificial Sequence
  Description of Artificial Sequence: Synthetic polypeptide
MEAPAQLLFLLLLWLPDTTGEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9682 - protein, 492 aa, Artificial Sequence
  Description of Artificial Sequence: Synthetic polypeptide
MEAPAQLLFLLLLWLPDTTGDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGASEVQLVQSGAEVKKPGESLRISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9683 - protein, 496 aa, Artificial Sequence
  Description of Artificial Sequence: Synthetic polypeptide
MDFQVQIFSFLLISASVIIARGVDIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDLEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9684 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGSGSGGGGASAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9685 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASQVQLVESGGGVVQPGRSLRLSCAASGFTFSGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9686 - protein, 503 aa, Artificial Sequence; identical to SEQ ID NO: 4650
  Description of Artificial Sequence: Synthetic polypeptide

SEQ ID NO: 9687 - protein, 500 aa, Artificial Sequence
  Description of Artificial Sequence: Synthetic polypeptide
MEAPAQLLFLLLLWLPDTTGAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSGGGGSGGGGSGGGGSGGGGSASEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9688 - protein, 473 aa, Artificial Sequence
  Description of Artificial Sequence: Synthetic polypeptide
DIQMTQSPASLSASVGETVTITCRTSENVYSYLAWYQQKQGKSPQLLVSFAKTLAEGVPSRFSGSGSGTQFSLKISSLQPEDSGSYFCQHHSDNPWTFGGGTELEIKGGGGSGGGGSGGGGSSAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSDLEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9689 - protein, 473 aa, Artificial Sequence
  Description of Artificial Sequence: Synthetic polypeptide
EIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9690 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDYWGQGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9691 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9692 - protein, 480 aa, Artificial Sequence
  Description of Artificial Sequence: Synthetic polypeptide
AVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSGGGGSGGGGSGGGGSGGGGSASEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9693 - protein, 472 aa, Artificial Sequence
  Description of Artificial Sequence: Synthetic polypeptide
EIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9694 - protein, 483 aa, Artificial Sequence; identical to SEQ ID NO: 4916
  Description of Artificial Sequence: Synthetic polypeptide

SEQ ID NO: 9695 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDVWGQGTTVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9696 - protein, 495 aa, Artificial Sequence
  Description of Artificial Sequence: Synthetic polypeptide
MDFQVQIFSFLLISASVIIARGVEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9697 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDPWGQGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9698 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMEHWGQGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9699 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDVWGQGTMVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9700 - protein, 473 aa, Artificial Sequence
  Description of Artificial Sequence: Synthetic polypeptide
EIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDIWGQGTMVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9701 - protein, 500 aa, Artificial Sequence
  Description of Artificial Sequence: Synthetic polypeptide
MEAPAQLLFLLLLWLPDTTGAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSGGGGSGGGGSGGGGSGGGGSASEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGSSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9702 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9703 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASAVQLQQSGPESEKPGASVKISCKASGYSFTGYNMNWVKQNNGKSLEWIGNIDPYYGGTTYNRKFKGKATLTVDKSSSTAYMQLKSLTSEDSAVYYCARSVGPMDYWGQGTSVTVSSSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9704 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASQVQLVESGGGVVQPGRSLRLSCAASGFTFSGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9705 - protein, 492 aa, Artificial Sequence; identical to SEQ ID NO: 9685
  Description of Artificial Sequence: Synthetic polypeptide

SEQ ID NO: 9706 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVESGGGLVQPGGSLRLSCAASGFTFSGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9707 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVESGGGLVQPGGSLRLSCAASGFTFSGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9708 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVESGGGSVQPGGSLRLSCAASGFTFSGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9709 - protein, 492 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVESGGGSVQPGGSLRLSCAASGFTFSGYNMNWVRQMPGKGLEWMGNIDPYYGGTTYNRKFKGQVTISADKSISTAYLQWSSLKASDTAMYYCARSVGPMDYWGRGTLVTVSSSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9710 - protein, 493 aa, Artificial Sequence
  Description of Artificial Sequence: Synthetic polypeptide
MEAPAQLLFLLLLWLPDTTGEIVLTQSPATLSLSPGERATLSCRASQSVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9711 - protein, 493 aa, Artificial Sequence
  Description of Artificial Sequence: Synthetic polypeptide
MEAPAQLLFLLLLWLPDTTGEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDYWGQGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9712 - protein, 493 aa, Artificial Sequence
  Description of Artificial Sequence: Synthetic polypeptide
MEAPAQLLFLLLLWLPDTTGEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9713 - protein, 493 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9714 - protein, 493 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSSEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9715 - protein, 493 aa, Artificial Sequence
  Description of Artificial Sequence: Synthetic polypeptide
MEAPAQLLFLLLLWLPDTTGEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGTGEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDLWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9716 - protein, 493 aa, Artificial Sequence
  Description of Artificial Sequence: Synthetic polypeptide
MEAPAQLLFLLLLWLPDTTGEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVQSGAEVKKPGESLKISCKGSGYSFTSYNMNWVRQMPGKGLEWMGNIDPYYGGTNYAQKFQGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9717 - protein, 485 aa, Artificial Sequence
  Description of Artificial Sequence: Synthetic polypeptide
MEAPAQLLFLLLLWLPDTTGEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGSGGGASEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9718 - protein, 493 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9719 - protein, 493 aa, Artificial Sequence
  Description of Artificial Sequence: Synthetic polypeptide
MEAPAQLLFLLLLWLPDTTGEIVLTQSPATLSLSPGERATLSCRTSENVYSYLAWYQQKPGQAPRLLIYFAKTLAEGIPARFSGSGSGTDFTLTISSLEPEDFAVYYCQHHSDNPWTFGQGTKVEIKGGGGSGGGGSGGGGASEVQLVQSGAEVKKPGESLRISCKGSGYSFTGYNMNWVRQMPGKGLEWMGNIDPYYGGTTYNRKFKGQVTISADKSISTAYLQWSSLKASDTAMYYCARSVGPMDYWGRGTLVTVSSDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9720 - protein, 113 aa, Artificial Sequence
  Description of Artificial Sequence: Synthetic polypeptide
EVQLLESGGGLVQPGGSLRLSCAASGFTFRDYEWWVRQAPGKGLERVSAINPQGTRTYYADSVGRFTISRDNSNTLYLQMNSLRAEDTAVYYCAKLPFYFHEWGQGTLVTVSS

SEQ ID NO: 9721 - protein, 118 aa, Artificial Sequence
  Description of Artificial Sequence: Synthetic polypeptide
EVQLLESGGGLVQPGGSLRLSCAASGFTFADEPMTWVRQAPGKGLEWVSRIPPEGAPTYYADSVGRFTISRDNSKNTLYLQMNSLRAEDTAVYYCAKGLIPDLQFDYWGQGTLVTVSS

SEQ ID NO: 9722 - protein, 118 aa, Artificial Sequence
  Description of Artificial Sequence: Synthetic polypeptide
EVQLLESGGGLVQPGGSLRLSCAASGFTFQDSDMTWVRQAPGGLEWVSAIAAPGGSTYYADSVKGRFTISRDNSKNTLYLQMNSLRAEDTAVYYCAKDRIPNLRFDYWGQGTLVTVSS

SEQ ID NO: 9723 - protein, 117 aa, Artificial Sequence
  Description of Artificial Sequence: Synthetic polypeptide
EVQLLESGGGLVQPGGSLRLSCAASGFTFVSDTMSVRQAPGGLEWVSRIDGTGGDTYYADSVKGRFTISRDNSKNTLYLQMNSLRAEDTAVYYCAKGQVPELLFDYWGQGTLVTVSS

SEQ ID NO: 9724 - protein, 117 aa, Artificial Sequence
  Description of Artificial Sequence: Synthetic polypeptide
EVQLLESGGGLVQPGGSLRLSCAASGFTFQDSDMTWVRQAPGGLEWVSAIAAPGGSTYYADSVKGRFTISRDNSNTLYLQMNSLRAEDTAVYYCAKDRIPNLVFDYWGQGTLVTVSS

SEQ ID NO: 9725 - protein, 118 aa, Artificial Sequence
  Description of Artificial Sequence: Synthetic polypeptide
EVQLLESGGGLVQPGGSLRLSCAAAGFTFDLAETWVRQAPGKGLEWVSRIDEDGASTYYADSVKGRFTISRDNSKNTLYLQMNSLRAEDAAVYYCAEGVIPSLTFDYWGQGTLVTVSS

SEQ ID NO: 9726 - protein, 116 aa, Artificial Sequence
  Description of Artificial Sequence: Synthetic polypeptide
EVQLLESGGGLVQPGGSLRLSCAASGFTFTDKHMSWVRQAPGGLEVSRISPDGTYTYYADSVKGRFTISRDNSKNTLYLQMNSLRAEDAAVYYCAEGVIPSLTFDYGQGTLVTVSS

SEQ ID NO: 9727 - protein, 119 aa, Artificial Sequence
  Description of Artificial Sequence: Synthetic polypeptide
EVQLLESGGGLVQPGGSLRLSCAASGFTFAEDDMTWVRQAPGKGLEWVSRIAVDGDRTYYADSVKGRFTISRDNSKNTLYLQMNSLRTEDTAVYYCAKGKTPHLVFDYWGQGTLVTVSS

SEQ ID NO: 9728 - protein, 118 aa, Artificial Sequence
  Description of Artificial Sequence: Synthetic polypeptide
EVQLLESGGGLVQPGGSLRLSCAAAGFTFDLAEMTWVRQAPGGLEWVSRIDEDGASTYYADSVKGRFTISRDNSKNTLYLQMNSLRAEDTAVYYCAKGQVPALVFDYWGQGTLVTVSS

SEQ ID NO: 9729 - protein, 118 aa, Artificial Sequence
  Description of Artificial Sequence: Synthetic polypeptide
EVQLLESGGGLVQPGGSLRLSCAASGFTFEDSMMSWVRQAPGKGLEWVSRIDPGGAQTYYADSVGRFTISRDNSKNTLYLQMNSLRAEDTAVYYCAKGVTPDLTFDYWGQGTLVTVSS

SEQ ID NO: 9730 - protein, 117 aa, Artificial Sequence
  Description of Artificial Sequence: Synthetic polypeptide
EVQLLESGGGLVQPGGSLRLSCAASGFTFEHADMSWVRQASGGLEWVSRIDNSGQSTYYADSVKGRFTISRDNSNTLYLQMNSLRAEDTAVYYCAKGVTPDLTFDYWGQGTLVTVSS

SEQ ID NO: 9731 - protein, 115 aa, Artificial Sequence
  Description of Artificial Sequence: Synthetic polypeptide
EVQLLESGGGLVQPGGSLRLSCAASGFTFEWYEMQWVRQAPGKGLEWVSAISGDGYRTYYADSVGRFTISRDNSKNTLYLQMNSLRAEDTAVYYCAKELGYFDYWGQGTLVTVSS

SEQ ID NO: 9732 - protein, 118 aa, Artificial Sequence
  Description of Artificial Sequence: Synthetic polypeptide
EVQLLESGGGLVQPGGSLRLSCAASGFTFSEAEMNWVRQAPGKGLEWVSRITTDGDSTYYADSVKGRFTISRDNSNTLYLQMNSLRAEDTAVYYCAKGRIPTLHFDYWGQGTLVTVSS

SEQ ID NO: 9733 - protein, 118 aa, Artificial Sequence
  Description of Artificial Sequence: Synthetic polypeptide
EVQLLESGGGLVQPGGSLRLSCAASGFTFDDSDMTWVRQAPGSLEWVSYIRGDDDETYYADSVKGRFTISRDNSKNTLYLQMNSLRAEDTAVYYCAKNRIPDLVFDYWGQGTLVTVSS

SEQ ID NO: 9734 - protein, 121 aa, Artificial Sequence
  Description of Artificial Sequence: Synthetic polypeptide
EVQLLESGGGLVQPGGSLRLSCAASGFTFNVADMQWVRQAPGKGLEWVSSISPNGWDTYYADSVKGRFTISRDNSKNTLYLQMNSLRAEDTAVYYCAKHASTEGPTAFDYWGQGTLVTVSS

SEQ ID NO: 9735 - protein, 115 aa, Artificial Sequence
  Description of Artificial Sequence: Synthetic polypeptide
EVQLLESGGGLVQPGGSLRLSCAASGFTFGPYDMGWVRQAPGKGLEWVSWISAHGSFTYYADSVKGRFTISRDNSKNTLYLQMNSLRAEDTAVYYCAKWPYFDYWGQGTLVTVSS

SEQ ID NO: 9736 - protein, 119 aa, Artificial Sequence
  Description of Artificial Sequence: Synthetic polypeptide
EVQLLESGGGLVQPGGSLRLSCAASGFTFGSGSMSWVRQAPGKGLEWVSRIGSNGADTYYADSVKGRFTISRDNSKNTLYLQMNSLRAEDTAVYYCAKGMVPNLVFDYWGQGTLVTVSS

SEQ ID NO: 9737 - protein, 117 aa, Artificial Sequence
  Description of Artificial Sequence: Synthetic polypeptide
EVQLLESGGGLVQPGGSLRLSCAASGFTFNRFDMTWVRQAPGKGLEVSAISGSGGSTYYADSVKGRFTISRDNSNTLYLQMNSLRAEDTAVYYCAKDRIPNLVFDYWGQGTLVTVSS

SEQ ID NO: 9738 - protein, 115 aa, Artificial Sequence
  Description of Artificial Sequence: Synthetic polypeptide
EVQLLESGGGLVQPGGSLRLSCAASGFTFGESDMKWVRQAPGGLEWVSSISPNGWDTYYADSVGRFTISRDNSKNTLYLQMNSLRAEDTAVYYCASPSSRLKFDYWGQGTLTVSS

SEQ ID NO: 9739 - protein, 117 aa, Artificial Sequence
  Description of Artificial Sequence: Synthetic polypeptide
EVQLLESGGGLVQPGGSLRLSCAASGFTFDSSEMSVRQAPGKGLEWVSSIENQGGATYYADSVKGRFTISRDNSKNTLYLQMNSLRAEDTAVYYCAKDRIPLVFDYWGQGTLVTVSS

SEQ ID NO: 9740 - protein, 116 aa, Artificial Sequence
  Description of Artificial Sequence: Synthetic polypeptide
EVQLLESGGGLVQPGGSLRLSCAASGFTLDAYPMYWVRQAPGKGLEWVSWIASGGGATYYADSVKGRFTISRDNSKNTLYLQMNSLRAEDTAVYYCAKRTKNFDYWGQGTLVTVSS

SEQ ID NO: 9741 - protein, 118 aa, Artificial Sequence
  Description of Artificial Sequence: Synthetic polypeptide
EVQLLESGGGLVQPGGSLRLSCAASGFTFMSYSMAWVRQAPGKGLEWVSGITSNGNRTYYADSVGRFTISRDNSKNTLYLQMNSLRAEDTAVYYCASTGANSRNFDYWGQGTLVTVSS

SEQ ID NO: 9742 - protein, 113 aa, Artificial Sequence
  Description of Artificial Sequence: Synthetic polypeptide
EVQLLESGGGLVQPGGSLRLSCAASGFTFEEEEMIWVRQAPGGLEVSAISGSGGSTYYADSVKGRFTISRDNSKNTLYLQMNSLRAEDTAVYYCAKEPFFDYWGQGTLVTVSS

SEQ ID NO: 9743 - protein, 119 aa, Artificial Sequence
  Description of Artificial Sequence: Synthetic polypeptide
EVQLLESGGGLVQPGGSLRLSCAASGFTFEGYLMSWVRQAPGKGLEWVSSIAANGMQTYYADSVGRFTISRDNSKNTLYLQMNSLRAEDTAVYYCAKKPRGIWDGDFDYGQGTLVTVSS

SEQ ID NO: 9744 - protein, 118 aa, Artificial Sequence
  Description of Artificial Sequence: Synthetic polypeptide
EVQLLESGGGLVQPGGSLRLSCAASGFTFHESTMTWVRQAPGKGLEWVSTIRHPGEFTYYADSVKGRFTISRDNSNTLYLQMNSLRAGDTAVYYCAKGLIPDLQFDYWGQGTLVTVSS

SEQ ID NO: 9745 - protein, 120 aa, Artificial Sequence
  Description of Artificial Sequence: Synthetic polypeptide
EVQLLESGGGLVQPGGSLRLSCAASGFTFAMYSMSWVRQAPGGLEWVSSIAPPGGRTYYADSVKGRFTISRDNSKNTLYLQMNSLRAEDTAVYYCAKQSLTGYSRSFDYWGQGTLVTVSS

SEQ ID NO: 9746 - protein, 118 aa, Artificial Sequence
  Description of Artificial Sequence: Synthetic polypeptide
EVQLLESGGGLVQPGGSLRLSCAASGFTFSQNPMSWVRHAPGKGLEVSTIPANGRPTSYADSVGRFTISRDNSKNTLYLQMNSLRAEDTAVYYCAKYSQQPGRRFDYWGQGTLVTVSS

SEQ ID NO: 9747 - protein, 116 aa, Artificial Sequence
  Description of Artificial Sequence: Synthetic polypeptide
EVQLLESGGGLVQPGGSLRLSCAASGFTFANYHMTWVRQAPGGLEWVSSIPDSGQTYYADSVKGRFTISRDNSNTLYLQMNSLRAEDTAVYYCAKGRIPSLLFDYWGQGTLVTVSS

SEQ ID NO: 9748 - protein, 117 aa, Artificial Sequence
  Description of Artificial Sequence: Synthetic polypeptide
EVQLLESGGGLVQPGGSLRLSCAASGFTFAQYHMRWVRQAPGGLEWVSTINDIGSNTYYADSVKGRFTISRDNSKNTLYLQMNSLRAEDTAVYYCAVGGRGSFSFDYGQGTLVTVSS

SEQ ID NO: 9749 - protein, 118 aa, Artificial Sequence
  Description of Artificial Sequence: Synthetic polypeptide
EVQLLESGGGLVQPGGSLRLSCAASGFTFSSYDMKWVRQAPGKGLEWVSTISASGVFTYYADSVGRFTISRDNSNTLYLQMNSLRAEDTAVYYCAKREHAGQPPFDYWGQGTLVTVSS

SEQ ID NO: 9750 - protein, 118 aa, Artificial Sequence
  Description of Artificial Sequence: Synthetic polypeptide
EVQLLESGGGLVQPGGSLRLSCAASGFTFNGYAMSWVRQAPGKGLEWVSTINANGKYTYYADSVGRFTISRDNSKNTLYLQMNSLRAEDTAVYYCAKLTLASNYFDYWGQGTLVTVSS

SEQ ID NO: 9751 - protein, 120 aa, Artificial Sequence
  Description of Artificial Sequence: Synthetic polypeptide
EVQLLESGGGLVQPGGSLRLSCAASGFTFMDYDMKWVRQAPGKGLEWVSSITALGKKTYYADSVGRFTISRDNSKNTLYLQMNSLRAEDTAVYYCAKDSVKYPLNLFDYWGQGTLVTVSS

SEQ ID NO: 9752 - protein, 118 aa, Artificial Sequence
  Description of Artificial Sequence: Synthetic polypeptide
EVQLLESGGGLVQPGGSLRLSCAASGFTFPHYTMAWVRQAPGKGLEWVSSIQSPGWRTYYADSVGRFTISRDNSKNTLYLQMNSLRAEDTAVYYCAYGDGLPLTFDYWGQGTLVTVSS

SEQ ID NO: 9753 - protein, 114 aa, Artificial Sequence
  Description of Artificial Sequence: Synthetic polypeptide
EVQLLESGGGLVQPGGSLRLSCAASGFTFTEYEMIWVRQAPGKGLEWVSSISGNGANTYYADSVKGRFTISRDNSNTLYLQMNSLRAEDTAVYYCAKEPLRFDYGQGTLVTVSS

SEQ ID NO: 9754 - protein, 117 aa, Artificial Sequence
  Description of Artificial Sequence: Synthetic polypeptide
EVQLLESGGGLVQPGGSLRLSCAASGFTFSGTPMSWVRQAPGGLEWVSRIGDEGQETYYADSVKGRFTISRDNSKNTLYLQMNSLRAEDTAVYYCAGVTPDLTFDYWGQGTLVTVSS

SEQ ID NO: 9755 - protein, 118 aa, Artificial Sequence
  Description of Artificial Sequence: Synthetic polypeptide
EVQLLESGGGLVQPGGSLRLSCAASGFTFSSSSMSWVRQAPGKGLEWVSAIGSDGPSTYYADSVKGRFTISRDNSKNTLYLQMNSLRAEDTAVYYCAGRIPTLHFDYWGQGTLVTVSS

SEQ ID NO: 9756 - protein, 117 aa, Artificial Sequence
  Description of Artificial Sequence: Synthetic polypeptide
EVQLLESGGGLVQPGGSLRLSCAASGFTFNPGEMTWVRQAPGKGLEWVSSIDGSGSSTYYADSVKGRFTISRDNSNTLYLQMNSLRADDTAVYYCAGRIPTLHFDYWGQGTLVTVSS

SEQ ID NO: 9757 - protein, 118 aa, Artificial Sequence
  Description of Artificial Sequence: Synthetic polypeptide
EVQLLESGGGLVQPGGSLRLSCAASGFTFPESMMGWVRQAPGKGLEWVSSIGYPGATTYYADSVKGRFTISRDNSNTLYLQMNSLRAEDTAVYYCAKGGSRDDNFDYWGQGTLVTVSS

SEQ ID NO: 9758 - protein, 124 aa, Artificial Sequence
  Description of Artificial Sequence: Synthetic polypeptide
EVQLLESGGGLVQPGGSLRLSCAASGFTFGQHSMHWVRQAPGKGLEWVSSISVPGPKTYYADSVKGRFTISRDNSKNTLYLQMNSLRAEDTAVYYCAKSLRDLRPGDSKSFDYWGQGTLVTVSS

SEQ ID NO: 9759 - protein, 116 aa, Artificial Sequence
  Description of Artificial Sequence: Synthetic polypeptide
EVQLLESGGGLVQPGGSLRLSCAASGFTFGSAAMDWVRQAPGKGLEWVSSINDMGSNTYYADSVKGRFTISRDNSKNTLYLQMNSLRAEDTAVYYCAKQGGRFDYWGQGTLVTVSS

SEQ ID NO: 9760 - protein, 118 aa, Artificial Sequence
  Description of Artificial Sequence: Synthetic polypeptide
EVQLLESGGGLVQPGGSLRLSCAASGFTFGYDRMAWVRQAPGKGLEWVSSIDGPGGATYYADSVKGRFTISRDNSKNTLYLQMNSLRAEDTAVYYCAEGRRVPDFDYWGQGTLVTVSS

SEQ ID NO: 9761 - protein, 119 aa, Artificial Sequence
  Description of Artificial Sequence: Synthetic polypeptide
EVQLLESGGGLVQPGGSLRLSCAASGFTFGEYEMTWVRQAPGKGLEWVSRIDPFGSETYYADSVKGRFTISRDNSKNTLYLQMNSLRAEDTAVYYCAEGVVPDLNFDYWGQGTLVTVSS

SEQ ID NO: 9762 - protein, 119 aa, Artificial Sequence
  Description of Artificial Sequence: Synthetic polypeptide
EVQLLESGGGLVQPGGSLRLSCAASGFTFDKYVMGWVRQAPGKGLEVSTIGSYGGATYYADSVKGRFTISRDNSKNTLYLQMNSLRAEDTAVYYCAKRLTLSATKFDYWGQGTLVTVSS

SEQ ID NO: 9763 - protein, 117 aa, Artificial Sequence
  Description of Artificial Sequence: Synthetic polypeptide
EVQLLESGGGLVQPGGSLRLSCAASGFTFEDYVMGVRQAPGGLEWVSTIAHRGDITYYADSVKGRFTISRDNSKNTLYLQMNSLRAEDTAVYYCAKRRRLSDYRFDYWGQGTLTVSS

SEQ ID NO: 9764 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYAMRYARFDYWGQGTLVTVSS

SEQ ID NO: 9765 - protein, 119 aa, Artificial Sequence
  Description of Artificial Sequence: Synthetic polypeptide
EVQLLESGGGLVQPGGSLRLSCAASGFTFGQFDMYWVRQAPGKGLEWVSAISPAGTGTYYADSVKGRFTISRDNSKNTLYLQMNSLRAEDTAVYYCAKAGDRSSLFDYRGQGTLVTVSS

SEQ ID NO: 9766 - protein, 116 aa, Artificial Sequence
  Description of Artificial Sequence: Synthetic polypeptide
EVQLLESGGGLVQPGGSLRLSCAASGFTFKDTGMTWVRQAPGGLEWVSSISSYGRDTYYADSVKGRFTISRDNSKNTLYLQMNSLRAEDAAVYYCALNAALGFDYWGQGTLVTVSS

SEQ ID NO: 9767 - protein, 118 aa, Artificial Sequence
  Description of Artificial Sequence: Synthetic polypeptide
EVQLLESGGGLVQPGGSLRLSCAASGFTFGPYPMSWVRQAPGKGLEWVSGINAPGTRTYYADSVKGRFTISRDNSKNTLYLQMNSLRAEDTAVYYCAQQMSSGVFDYWGQGTLVTVSS

SEQ ID NO: 9768 - protein, 115 aa, Artificial Sequence
  Description of Artificial Sequence: Synthetic polypeptide
EVQLLESGGGLVQPGGSLRLSCAASGFTFSNQDMTWVRQAPGKGLEVSSIDSSGQLTYYADSVGRFTISRDNSKNTLYLQMNSLRAEDTAVYYCAKVSLARFDYWGQGTLVTVSS

SEQ ID NO: 9769 - protein, 113 aa, Artificial Sequence
  Description of Artificial Sequence: Synthetic polypeptide
EVQLLESGGGLVQPGGSLRLSCAASGFTFPESDMKWVRQAPGKGLEWVSSISPNGWDTYYADSVGFTISRDNSNTLYLQMNSLRAEDTAVYYCAKPAQVLFDYWGQGTLTVSS

SEQ ID NO: 9770 - protein, 117 aa, Artificial Sequence
  Description of Artificial Sequence: Synthetic polypeptide
EVQLLESGGGLVQPGGSLRLSCAASGFTFEQYVMGVRQAPGKGLEVSTIGTSGKYTYYADSVKGRFTISRDNSNTLYLQMNSLRAEDTAVYYCAQRRSLTRVHFDYWGQGTLVTVSS

SEQ ID NO: 9771 - protein, 119 aa, Artificial Sequence
  Description of Artificial Sequence: Synthetic polypeptide
EVQLLESGGGLVQPGGSLRLSCAASGFTFGVEHMSWVRQAPGKGLEWVSAITGDGDRTYYADSVKGRFTISRDNSKNTLYLQMNSLRAEDTAVYYCAKTVSWNGRFDYWGQGTLVTVSS

SEQ ID NO: 9772 - protein, 116 aa, Artificial Sequence
  Description of Artificial Sequence: Synthetic polypeptide
EVQLLESGGGLVQPGGSLRLSCAASGFTFAWYNMGWVRQAPGKGLEWVSRIAPSGIITYYADSVGRFTISRDNSKNTLYLQMNSLRAEDTAVYYCAKGLRGKFDYWGQGTLVTVSS

SEQ ID NO: 9773 - protein, 112 aa, Artificial Sequence
  Description of Artificial Sequence: Synthetic polypeptide
EVQLLESGGGLVQPGGSLRLSCAASGFTFSNYEMRVRQAPGGLEVSSISSAGTDTYYADSVKGRFTISRDNSKNTLYLQMNSLRAEDTAVYYCAKQSLNFDYGQGTLVTVSS

SEQ ID NO: 9774 - protein, 116 aa, Artificial Sequence
  Description of Artificial Sequence: Synthetic polypeptide
EVQLLESGGGLVQPGGSLRLSCVASGFTFDEEPMTWVRQAPGKGLEWVSIIDPGGGATYYADSVKGRFTISRDNSKNTLYLQMNSLRAEDTAVYYCAKSNSMFDYWGQGTLVTVSS

SEQ ID NO: 9775 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSNTLYLQMNSLRAEDTAVYYCAKLPFIFDYWGQGTLVTVSS

SEQ ID NO: 9776 - protein, 120 aa, Artificial Sequence
  Description of Artificial Sequence: Synthetic polypeptide
EVQLLESGGGLVQPGGSLRLSCAASGFTFSAYPMHWVRQAPGKGLEVSSIASSGITTYYADSVKGRFTISRDNSKNTLYLQMNSLRAEDTAVYYCAKFTRLHFPAQFDYWGQGTLVTVSS

SEQ ID NO: 9777 - protein, 119 aa, Artificial Sequence
  Description of Artificial Sequence: Synthetic polypeptide
EVQLLESGGGLVQPGGSLRLSCAASGFTFADYAMGWVRQAPGKGLEWVSRISPEGSRTYYADSVKGRFTISRDNSKNTLYLQMNSLRAEDTAVYYCAKLRPYASKFDYWGQGTLVTVSS

SEQ ID NO: 9778 - protein, 115 aa, Artificial Sequence
  Description of Artificial Sequence: Synthetic polypeptide
EVQLLESGGGLVQPGGSLRLSCAASGFTFRPYDMGVRQAPGKGLEWVSTISHQGNRTYYADSVKGRFTISRDNSKNTLYLQMNSLRAEDTAVYYCAKVSHHFDYWGQGTLVTVSS

SEQ ID NO: 9779 - protein, 115 aa, Artificial Sequence
  Description of Artificial Sequence: Synthetic polypeptide
EVQLLESGGGLVQPGGSLRLSCAASGFTFSAYNMWARQAPGKGLEWVSINSTGSRTYYADSVGRFTISRDNSKNTLYLQMNSLRAEDTAVYYCAKNWHRGRFDYWGQGTLVTVSS

SEQ ID NO: 9780 - protein, 115 aa, Artificial Sequence
  Description of Artificial Sequence: Synthetic polypeptide
EVQLLESGGGLVQPGGSLRLSCAASGFTFDRYRMGWVRQAPGGLEWVSTINRLGQSTYYADSVKGRFTISRDNSKNTLYLQMNSLRAEDTAVYYCAVKKHKFDYWGQGTLVTVSS

SEQ ID NO: 9781 - protein, 116 aa, Artificial Sequence
  Description of Artificial Sequence: Synthetic polypeptide
EVQLLESGGGLVQPGGSLRLSCAASGFTFAHYNMRWVRQAPGGLEWVSTITKTGFRTYYADSVKGRFTISRDNSKNTLYLQMNSLRAEDTAVYYCAKAGQFDFDYWGQGTLVTVSS

SEQ ID NO: 9782 - protein, 116 aa, Artificial Sequence
  Description of Artificial Sequence: Synthetic polypeptide
EVQLLESGGGLVQPGGSLRLSCAASGFTFYPYSMHWVRQAPGGLEWVSTIDGSGMFTYYADSVGRFTISRDNSKNTLYLQMNSLRAEDTAVYYCAEDSLKASFDYWGQGTLVTVSS

SEQ ID NO: 9783 - protein, 115 aa, Artificial Sequence
  Description of Artificial Sequence: Synthetic polypeptide
EVQLLESGGGLVQPGGSLRLSCAASGFTFPLYGMWWVRQAPGGLEWVSYIGPYGHTTYYADSVKGRFTISRDNSKNTLYLQMNSLRAEDTAVYYCAKRKKKFDYWGQGTLVTVSS

SEQ ID NO: 9784 - protein, 117 aa, Artificial Sequence
  Description of Artificial Sequence: Synthetic polypeptide
EVQLLESGGGLVQPGGSLRLSCAASGFTFPRYRMSWVRQAPGKGLEWVSSITPYGAHTYYADSVKGRFTISRDNSKNTLYLQMNSLRAEDTAVYYCAKYGKWYFDYWGQGTLVTVSS

SEQ ID NO: 9785 - protein, 115 aa, Artificial Sequence
  Description of Artificial Sequence: Synthetic polypeptide
EVQLLESGGGLVQPGGSLRLSCAASGFTFNEYAMRVRQAPGKGLEWVSTIDRLGLHTYYADSVKGRFTISRDNSNTLYLQMNSLRAEDTAVYYCAKSGPFTFDYWGQGTLVTVSS

SEQ ID NO: 9786 - protein, 115 aa, Artificial Sequence
  Description of Artificial Sequence: Synthetic polypeptide
EVQLLESGGGLVQPGGSLRLSCAASGFTFSTYHMQVRQAPGGLEWVSMIDADGLGTYYADSVGRFTISRDNSNTLYLQMNSLRAEDTAVYYCAKPGPQFGQFDYWGQGTLVTVSS

SEQ ID NO: 9787 - protein, 115 aa, Artificial Sequence
  Description of Artificial Sequence: Synthetic polypeptide
EVQLLESGGGLVQPGGSLRLSCAASGFTFERYNMRWVRQAPGGLEWVSTIDRLGLATYYADSVKGRFTISRDNSKNTLYLQMNSLRAEDTAVYYCAAGSWSFDYWGQGTLVTVSS

SEQ ID NO: 9788 - protein, 116 aa, Artificial Sequence
  Description of Artificial Sequence: Synthetic polypeptide
EVQLLESGGGLVQPGGSLRLSCAASGFTFGIYDMKWVRQAPGKGLEVSTISSSGTHTYYADSVKGRFTISRDNSKNTLYLQMNSLRAEDTAVYYCAKYPQPYPFDYWGQGTLTVSS

SEQ ID NO: 9789 - protein, 115 aa, Artificial Sequence
  Description of Artificial Sequence: Synthetic polypeptide
EVQLLESGGGLVQPGGSLRLSCAASGFTFVYDMRWVRQAPGGLEWVSTISATGVHTYYADSVKGRFTISRDNSNTLYLQMNSLRAEDTAVYYCAKYPPAGRFDYWGQGTLVTVSS

SEQ ID NO: 9790 - protein, 118 aa, Artificial Sequence
  Description of Artificial Sequence: Synthetic polypeptide
EVQLLESGGGLVQPGGSLRLSCAASGFTFSTYDMIWVRQAPGGLEWVSAISPNGTGTYYADSVKGRFTISRDNSKNTLYLQMNSLRAEDTAVYYCAKPPQVNTEFDYRGQGTLVTVSS

SEQ ID NO: 9791 - protein, 116 aa, Artificial Sequence
  Description of Artificial Sequence: Synthetic polypeptide
EVQLLESGGGLVQPGGSLRLSCAASGFTFEKEDMGWVRQAPGKGLEWVSHISPNGYATYYADSVKGRFTISRDNSKNTLYLQMNSLRAEDTAVYYCAKSWSSFDYWGQGTLVTVSS

SEQ ID NO: 9792 - protein, 116 aa, Artificial Sequence
  Description of Artificial Sequence: Synthetic polypeptide
EVQLLESGGGLVQPGGSLRLSCAASGFTFSATPMEWARQAPGKGLEWVSTISESGYSTYYADSVGRFTISRDNSNTLYLQMNSLRAEDTAVYYCAKWNSTTGFDYWGQGTLVTVSS

SEQ ID NO: 9793 - protein, 114 aa, Artificial Sequence
  Description of Artificial Sequence: Synthetic polypeptide
EVQLLESGGGLVQPGGSLRLSCAASGFTFNTVDMEWVRQAPGGLEWVSSISPNGDTYYADSVKGRFTISRDNSNTLYLQMNSLRAEDTAVYYCAEAPHRAFDYWGQGTLVTVSS

SEQ ID NO: 9794 - protein, 118 aa, Artificial Sequence
  Description of Artificial Sequence: Synthetic polypeptide
EVQLLESGGGLVQPGGSLRLSCAASGFTFEDEMSWVRQAPGKGLEWVSRIDALGDSTYYADSVKGRFTISRDNSKNTLYLQMNSLRAEDTAVYYCAEGMVPRLKFDYWGQGTLVTVSS

SEQ ID NO: 9795 - protein, 112 aa, Artificial Sequence
  Description of Artificial Sequence: Synthetic polypeptide
EVQLLESGGGLVQPGGSLRLSCAASGFTFSDHSMMWVRQAPGGLEWVSDIEPHGVHTYYADSVKGRFTISRDNSNTLYLQMNSLRAEDTAVYYCANPTFDYWGQGTLVTVSS

SEQ ID NO: 9796 - protein, 120 aa, Artificial Sequence
  Description of Artificial Sequence: Synthetic polypeptide
EVQLLESGGGLVQPGGSLRLSCAASGFTFSPHTMHWVRQAPGGLEWVSGIGPDGTTTYYADSVKGRFTISRDNSNTLYLQMNSLRAEDTAVYYCAKRSYSWDRGWTFDYWGQGTLVTVSS

SEQ ID NO: 9797 - protein, 119 aa, Artificial Sequence
  Description of Artificial Sequence: Synthetic polypeptide
EVQLLESGGGLVQPGGSLRLSCAASGFTFSGYDMQWVRQAPGKGLEWVSTISASGVFTYYADSVGRFTTSRDNSKNTLYLQMNSLRAEDTAVYYCAYPNRFALNNFDYWGQGTLVTVSS

SEQ ID NO: 9798 - protein, 117 aa, Artificial Sequence
  Description of Artificial Sequence: Synthetic polypeptide
EVQLLESGGGLVQPGGSLRLSCAASGFTFYASDMKWVRQAPGGLEWVSSISPNGWDTYYADSVGRFTISRDNSKNTLYLQMNSLRAEDTAVYYCAKADYTYHSFDYWGQGTLVTVSS

SEQ ID NO: 9799 - protein, 115 aa, Artificial Sequence
  Description of Artificial Sequence: Synthetic polypeptide
EVQLLESGGGLVQPGGSLRLSCAASGFTFAHYNMRWVRQAPGGLEMVSTITTGFRTYYADSVKGRFTISRDNSKNTLYLQMNSLRAEDTAVYYCAKAGQFDFDYWGQGTLVTVSS

SEQ ID NO: 9800 - protein, 117 aa, Artificial Sequence
  Description of Artificial Sequence: Synthetic polypeptide
EVQLLESGGGLVQPGGSLRLSCAASGFTFSHYHMGWARQAPGGLEWVSVIGPRGISTYYADSVKGRFTISRDNSKNTLYLQMNSLRAEDTAVYYCAKSPSRHRFDYWGQGTLVTVSS

SEQ ID NO: 9801 - protein, 117 aa, Artificial Sequence
  Description of Artificial Sequence: Synthetic polypeptide
EVQLLESGGGLVQPGGSLRLSCAASGFTFNEYAMRWVRQAPGKGLEWVSTIDRLGLHTYYADSVKGRFTISRDNSKNTLYLQMNSLRAEDTAVYYCAKSGPFTFDYWGQGTLVTVSS

SEQ ID NO: 9802 - protein, 122 aa, Artificial Sequence
  Description of Artificial Sequence: Synthetic polypeptide
EVQLLESGGGLVQPGGSLRLSCAASGFTFGNYSMKARQAPGKGLEWVSTITPDGWYTYYADSVKGRFTISRDNSKNTLYLQMNSLRAEDTAVYYCAKVGDAVWGWIGGFDYWGQGTLVTVSS

SEQ ID NO: 9803 - protein, 113 aa, Artificial Sequence
  Description of Artificial Sequence: Synthetic polypeptide
EVQLLESGGGLVQPGGSLRLSCAASGFTFGDYGMWVRQAPGKGLEVSAITSNGDFTYYADSVKGRFTISRDNSNTLYLQMNSLRAEDTAVYYCAKSLYKFDYWGQGTLVTVSS

SEQ ID NO: 9804 - protein, 121 aa, Artificial Sequence
  Description of Artificial Sequence: Synthetic polypeptide
EVQLLESGGGLVQPGGSLRLSCAGSGFTFPTYKMGWVRQAPGKGLEVSFIDYWGWRTYYADSVKGRFTISRDNSNTLYLQMNSLRAEDTAVYYCAKSPYSWTHDSPHFDYWGQGTLVTVSS

SEQ ID NO: 9805 - protein, 115 aa, Artificial Sequence
  Description of Artificial Sequence: Synthetic polypeptide
EVQLLESGGGLVQPGGSLRLSCAASGFTFRPYTMCWARQAPGKGLEWVSCISDAGSFTYYADSVKGRFTISRDNSNTLYLQMNSLRAEDTAVYYCAKRMSSFDYWGQGTLVTVSS

SEQ ID NO: 9806 - protein, 121 aa, Artificial Sequence
  Description of Artificial Sequence: Synthetic polypeptide
EVQLLESGGGLVQPGGSLRLSCAASGFTFQNYQMAWVRQAPGKGLEWVSTISGTGNTYYADSVKGRFTISRDNSKNTLYLQMNSLRAEDTAVYYCAKTPQNYFSVRRFDYWGQGTLVTVSS

SEQ ID NO: 9807 - protein, 115 aa, Artificial Sequence
  Description of Artificial Sequence: Synthetic polypeptide
EVQLLESGGGLVQPGGSLRLSCAASGFTFGAYTMGWVRQAPGGLEWVSISTSGGQTYYADSVGRFTISRDNSKNTLYLQMNSLRAEDTAVYYCAKPLNWWAFDYWGQGTLVTVSS

SEQ ID NO: 9808 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAGWPGTFGQGTKVEIKR

SEQ ID NO: 9809 - protein, 115 aa, Artificial Sequence
  Description of Artificial Sequence: Synthetic polypeptide
EVQLLESGGGLVQPGGSLRLSCAASGFTFNAYPMTWVRQAPGGLEWVSRIDGYGRHTYYADSVKGRFTISRDNSNTLYLQMNSLRAEDTAVYYCAKGIIPNFDYWGQGTLVTVSS

SEQ ID NO: 9810 - protein, 119 aa, Artificial Sequence
  Description of Artificial Sequence: Synthetic polypeptide
EVQLLESGGGLVQPGGSLRLSCAASQFTFGAVDMTWVRQAPGKGLEWVSAISPSGSATYYADSVKGRFTISRDNSKNTLYLQMNSLRAEDTAVYYCAKGRVPDLGFDYWGQGTLVTVSS

SEQ ID NO: 9811 - protein, 117 aa, Artificial Sequence
  Description of Artificial Sequence: Synthetic polypeptide
EVQLLESGGGLVQPGGSLRLSCAASGFTFDSYAMGWARQAPGKGLEWVSAIGAKGLSTYYADSVKGRFTISRDNSKNTLYLQMNSLRAEDTAVYYCAKAARGKFDYWGQGTLVTVSS

SEQ ID NO: 9812 - protein, 116 aa, Artificial Sequence
  Description of Artificial Sequence: Synthetic polypeptide
EVQLLESGGGLVQPGGSLRLSCAASGFTFTRYQMGWVRQAPGKGLEWVSVINVWGSSTYYADSVKGRFTISRDNSKNTLYLQMNSLRAEDTAVYYCAKMSGKFAYWGQGTLVTVSS

SEQ ID NO: 9813 - protein, 114 aa, Artificial Sequence
  Description of Artificial Sequence: Synthetic polypeptide
EVQLLESGGGLVQPGGSLRLSCAASGFTFGNYSMMWVRQAPGGLEVSTIIPAGTSTYYADSVGRFTISRDNSKNTLYLQMNSLRAEDTAVYYCAKPSIRLFDYWGQGTLVTVSS

SEQ ID NO: 9814 - protein, 116 aa, Artificial Sequence
  Description of Artificial Sequence: Synthetic polypeptide
EVQLLESGGGLVQPGGSLRLSCAASGFTFGAYDMGWVRQAPGKGLEWVSWISPNGYDTYYADSVKGRFTISRDNSKNTLYLQMNSLRAEDTAVYYCAKGGVKFDYWGQGTLVTVSS

SEQ ID NO: 9815 - protein, 120 aa, Artificial Sequence
  Description of Artificial Sequence: Synthetic polypeptide
EVQLLESGGGLVQPGGSLRLSCAASGFTFVWYEMAWVRQAPGGLEWVSTIQADGEQTYYADSVGRFTISRDNSKNTLYLQMNSLRAEDTAVYYCAKASYALVYPPEEFDYGQGTLVTVSS

SEQ ID NO: 9816 - protein, 119 aa, Artificial Sequence
  Description of Artificial Sequence: Synthetic polypeptide
EVQLLESGGGLVQPGGSLRLSCAASGFTFTNYRMSWVRQAPGKGLEVSAIDDLGVSTYYADSVGRFTISRDNSKNTLYLQMNSLRAEDTAVYYCAKWRLKNSQPTDFDYGQGTLVTVSS

SEQ ID NO: 9817 - protein, 116 aa, Artificial Sequence
  Description of Artificial Sequence: Synthetic polypeptide
EVQLLESGGGLVQPGGSLRLSCAASGFTFDQAHMWVRQAPGGLEWVSFINPSGYYTYYADSVGRFTISRDNSKNTLYLQMNSLRAEDTAVYYCAKPSLSPSSFDYWGQGTLVTVSS

SEQ ID NO: 9818 - protein, 114 aa, Artificial Sequence
  Description of Artificial Sequence: Synthetic polypeptide
  MOD_RES (104)..(104): Selenocysteine
EVQLLESGGGLVQPGGSLRLSCAASGFTFETGQGWARQAPGGLEVSNIDGSGTYTYYADSVGRFTISRDNSKNTLYLQMNSLRAEDTAVYYCAKSTQNYRFDYXGQGTLVTVSS

SEQ ID NO: 9819 - protein, 107 aa, Artificial Sequence
  Description of Artificial Sequence: Synthetic polypeptide
DIQMTQSPSSLSASVGDRVTITCRASQTIERRLNWYQQPGKAPKLLIYLASRLQSGVPSRFSGSGSGTDFTLTISSLQPEDFATYYCHQYASPPLTFGQGTKVEIKR

SEQ ID NO: 9820 - protein, 118 aa, Artificial Sequence
  Description of Artificial Sequence: Synthetic polypeptide
EVQLLESGGGLVQPGGSLRLSCAASGFTFGAYPMYWVRQAPGGLEWVSSIHKDGRITYYADSVKGRFTISRDNSKNTLYLQMNSLRAEDTAVYYCAKQGTPVDGFDYWGQGTLVTVSS

SEQ ID NO: 9821 - protein, 120 aa, Artificial Sequence
  Description of Artificial Sequence: Synthetic polypeptide
EVQLLESGGGLVQPGGSLRLSCAASGFTFPDEGMTWVRQAPGKGLEWVSTIETGGTVTYYADSVGRFTISRDNSKNTLYLQMNSLRAEDTAVYYCAKMDGSGTWQTFDYWGQGTLVTVSS

SEQ ID NO: 9822 - protein, 115 aa, Artificial Sequence
  Description of Artificial Sequence: Synthetic polypeptide
EVQLLESGGGLVQPGGSLRLSCAASGFTFDSLGMGWARQAPGKGLEWVSYIRAEGAYTYYADSVKGRFTISRDNSNTLYLQMNSLRAEDTAVYYCAKYLADSDYWGQGTLVTVSS

SEQ ID NO: 9823 - protein, 120 aa, Artificial Sequence
  Description of Artificial Sequence: Synthetic polypeptide
EVQLLESGGGLVQPGGSLRLSCAASGFTFSESYMEWVRQAPGKGLEWVSGIDHIGGGTYYADSVKGRFTISRDNSKNTLYLQMNSLRAEDTAVYYCAKDDGRGGSMFDYWGQGTLVTVSS

SEQ ID NO: 9824 - protein, 113 aa, Artificial Sequence
  Description of Artificial Sequence: Synthetic polypeptide
EVQLLESGGGLVQPGGSLRLSCAASGFTFSGGYMWWVRQAPGGLEWVSSIGASGAYTYYADSVGRFTISRDNSKNTLYLQMNSLAEDTAVYYCAKTGGRLDYWGQGTLVTVSS

SEQ ID NO: 9825 - protein, 118 aa, Artificial Sequence
  Description of Artificial Sequence: Synthetic polypeptide
EVQLLESGGGLVQPGGSLRLSCAASGFTFDEGHMGWVRQAPGKDLEWVSYIGSLGLHTYYADSVGRFTISRDNSKNTLYLQMNSLRAEDTAVYYCAKREFSNGGFDYWGQGTLVTVSS

SEQ ID NO: 9826 - protein, 117 aa, Artificial Sequence
  Description of Artificial Sequence: Synthetic polypeptide
EVQILESGGGLVQPGGSLRLSCMSGFTFTSPMYWVRQAPGKGLEWVSSIDRTGGHTYYADSVKGRFTISRDNSKNTLYLQMNSLRAEDTAVYYCAQALLTDARFDYWGQGTLVTVSS

SEQ ID NO: 9827 - protein, 120 aa, Artificial Sequence
  Description of Artificial Sequence: Synthetic polypeptide
EVQLLESGGGLVQPGGSLRLSCAASGFTFDGRDMVWVRQAPGKGLEWVSAISPSGLDTYYADSVKGRFTISRDNSKNTLYLQMNSLRAEDTAVYYCAERPQMLVTNFDYWGQGTLVTVSS

SEQ ID NO: 9828 - protein, 119 aa, Artificial Sequence
  Description of Artificial Sequence: Synthetic polypeptide
EVQLLESGGGLVQPGGSLRLSCAASGFTFGNDPMSWVRQAPGKGLEWVSGIGREGDSTYYADSVKGRFTISRDNSKNTLYLQMNSLRAEDTAVYYCAKDSMRHQPFDYWGQGTLVTVSS

SEQ ID NO: 9829 - protein, 115 aa, Artificial Sequence
  Description of Artificial Sequence: Synthetic polypeptide
EVQLLESGGGLVQPGGSLRLSCAASGFTFDETYMWVRQAPGKGLEWVSAIGASGADTYYADSVGRFTISRDNSNTLYLQMNSLRAEDTAVYYCAFTHLNGRFDYWGQGTLVTVSS

SEQ ID NO: 9830 - protein, 115 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCADPYSFDYWGQGTLVTVSS

SEQ ID NO: 9831 - protein, 118 aa, Artificial Sequence
  Description of Artificial Sequence: Synthetic polypeptide
EVQLLESGGGLVQPGGSLRLSCAASGFTFGGWPMGWVRQAPGKGLEWVSGIDIDGAPTYYADSVKGRFTISRDNSNTLYLQMNSLRAEDTAVYYCAKEEAGSWSFDYWGQGTLVTVSS

SEQ ID NO: 9832 - protein, 114 aa, Artificial Sequence
  Description of Artificial Sequence: Synthetic polypeptide
EVQLLESGGGLVQPGGSLRLSCAASGFTFSDQAMWWARQAPGKGLEWVSFIQGDGGFTYYADSVKGRFTISRDNSKNTLYLQMNSLRAEDTAVYYCAPSPFDYWGQGTLVTVSS

SEQ ID NO: 9833 - protein, 116 aa, Artificial Sequence
  Description of Artificial Sequence: Synthetic polypeptide
EVQLLESGGGLVQPGGSLRLSCAASGFTFETGQMGWARQAPGGLEWVSNIDGSGTYTYYADSVGRFTISRDNSKNTLYLQMNSLRAEDTAVYYCAKAVRNFAFDYWGQGTLVTVSS

SEQ ID NO: 9834 - protein, 123 aa, Artificial Sequence
  Description of Artificial Sequence: Synthetic polypeptide
EVQLLESGGGLVQPGGSLRLSCAASGFTFSGHDMSWVRQAPGKGLEWVSAISPHGTHTYYADSVGRFTISRDNSKNTLYLQMNSLRAEDTAVYYCAKGIRGWIGHDTQPFDYWGQGTLVTVSS

SEQ ID NO: 9835 - protein, 119 aa, Artificial Sequence
  Description of Artificial Sequence: Synthetic polypeptide
EVQLLESGGGLVQPGGSLRLSCAASGFTFESKDMLWVRQAPGKGLEWVSSISSDGTHTYYADSVKGRFTISRDNSKNTLYLQMNSLRAEDTAVYYCAQELGGSWQFDYWGQGTLVTVSS

SEQ ID NO: 9836 - protein, 122 aa, Artificial Sequence
  Description of Artificial Sequence: Synthetic polypeptide
EVQLLESGGGLVQPGGSLRLSCAASGFTFADRDMVWVRQAPGKGLEWVSGIGASGTSTYYADSVKGRFTISRDNSKNTLYLQMNSLRAEDAAVYYCAKGGTGPTDLWDFDYWGQGTLVTVSS

SEQ ID NO: 9837 - protein, 119 aa, Artificial Sequence
  Description of Artificial Sequence: Synthetic polypeptide
EVQLLESGGGLVQPGGSLRLSCAASGFTFDDEKMLWVRQAPGKGLEWVSSISVSGLHTYYADSVKGRFTISRDNSKNTLYLQMNSLRAEDTAVYYCAKEEAGSWSFDYWGQGTLVTVSS

SEQ ID NO: 9838 - protein, 119 aa, Artificial Sequence
  Description of Artificial Sequence: Synthetic polypeptide
EVQLLESGGGLVQPGGSLRLSCAASGFTFGQERMIWVRQAPGKGLEWVSDISASGGTTYYADSVKGRFTISRDNSKNTLYLQMNSLRAEDTAVYYCAKEEAGSWSFDYWGQGTLVTVSS

SEQ ID NO: 9839 - protein, 116 aa, Artificial Sequence
  Description of Artificial Sequence: Synthetic polypeptide
EVQLLESGGGLVQPGGSLRLSCAASGFTFEWYEMQWVRQAPGKGLEWVSAISGDGYRTYYADSVKGRFTISRDNSMNTLYLQMNSLRAEDTAVYYCAKELGYFDYRGRGTLVTVSS

SEQ ID NO: 9840 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELGYFDYWGRGTLVTVSS

SEQ ID NO: 9841 - protein, 118 aa, Artificial Sequence
  Description of Artificial Sequence: Synthetic polypeptide
EVQLLESGGGLVQPGGSLRLSCAASGFTFPTAEMVVRQAPGKGLEWVSSISASGGSTYYADSVKGRFTISRDNSKNTLYLQMNSLRAEDTAVYYCAEPVSYVATFDYWGQGTLVTVSS

SEQ ID NO: 9842 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELGYFDYRVQGTLVTVSS

SEQ ID NO: 9843 - protein, 114 aa, Artificial Sequence
  Description of Artificial Sequence: Synthetic polypeptide
EVQLLESGGGLVQPGGSLRLSCAASGFTFEWYEMQWVRKAPGGLEWVSAISGDGYRTYYADSVKGRFTISRDNSKNTLYLQMNSLRAEDTAVYYCAKELGYFDYGRGTLVTVSS

SEQ ID NO: 9844 - protein, 115 aa, Artificial Sequence
  Description of Artificial Sequence: Synthetic polypeptide
EVQLLESGGGLVQPGGSLRLSCAASGFTFEWYEMQWVRQAPGGLEWISAISGDGYRTYYADSVKGRFTISRDNSKNTLYLQMNSLRAEDTAVYYCAKELGYFDYRVQGTLVTVSS

SEQ ID NO: 9845 - protein, 114 aa, Artificial Sequence
  Description of Artificial Sequence: Synthetic polypeptide
EVQLLESGGGLVQPGGSLRLSCAASGFTFEWYEMQWVRRAPGKGLEVSAISGDGYRTYYADSVGRFTISRDNSENTLYLQMNSLRAEDTAVYYCAKELGYFDYWGRGTLVTVSS

SEQ ID NO: 9846 - protein, 113 aa, Artificial Sequence
  Description of Artificial Sequence: Synthetic polypeptide
EVQLLETGGGLVQPGGSLRLSCAASGFTFEWYEMQVRRAPGKGLEWVSAISGDGYRTYYADSVGRFTISRDNSKNTLYLQMDSLRAEDTAVYYCAKELGYFDYGRGTLVTVTS

SEQ ID NO: 9847 - protein, 116 aa, Artificial Sequence
  Description of Artificial Sequence: Synthetic polypeptide
EVQLLESGGGLVQPGGSLRLSCAASGFTFEWYEMQWVRQAPGKGLEWVSAISGDGYRTYYADSVKGRFTISRDNSKNTLYLQMNSLRAEDTAVYYCAKELGYFHYWGRGTLVTVSS

SEQ ID NO: 9848 - protein, 116 aa, Artificial Sequence
  Description of Artificial Sequence: Synthetic polypeptide
EVQLLESGGGLVQPGGSLRLSCVASGFTFEWYEMQWVRQAPGNGLEWISAISGDGYRTYYADSVKGRFTISRDNSKNTLYLQMNSLRAEDTAVYYCAKELGYFDYWGRGTLVTVSS

SEQ ID NO: 9849 - protein, 114 aa, Artificial Sequence
  Description of Artificial Sequence: Synthetic polypeptide
EVQLLESGGGLVQPGGSLRLSCAASGFTFEWYEMQWVRRAPGGLEWVSAISGDGYRTYYADSVGRFTISRDNSKNTLYLLMNSLRAEDTAVYYCAKELGYFDYWGRGTLVTVSS

SEQ ID NO: 9850 - protein, 116 aa, Artificial Sequence
  Description of Artificial Sequence: Synthetic polypeptide
EVQLLESGGGLVQPGGSLRLSCAASGFTFEWYEMQWVRKAPGKGLEWVSAISGDGYRTYYADSVKGRFTISRDNSKNTLYLQMNSLRAEDTAVYYCAKELGYFDYRGRGTLVTVSS

SEQ ID NO: 9851 - protein, 115 aa, Artificial Sequence
  Description of Artificial Sequence: Synthetic polypeptide
EVQLLESGGGLVQPGGSMRLSCAASGFTFEWYEMQWVRRAPGKGLEWVSAISGDGYRTYYADSVKGRFTISRDNSKNTLYLQMNSLRAEDTAVYYCAELGYFDYRGRGTLVTVSS

SEQ ID NO: 9852 - protein, 105 aa, Artificial Sequence
  Description of Artificial Sequence: Synthetic polypeptide
DIQMTQSPSSLSASVGDRVTITCRASHFIGTLLSWYQQKPGKAPKLLITYGSLLQSGVPSRFSGSGSGTDFTLTISSLQPEDFATYYCGQGVLPATFGQGTVEIR

SEQ ID NO: 9853 - protein, 115 aa, Artificial Sequence
  Description of Artificial Sequence: Synthetic polypeptide
EVQLLESGGGLVQPGGSLRLSCAASGFTFEWYEMQWVRRAPGGLEWVSMISGDGYRTYYADSVKGRFTISRDNSKNTLYLQMNSLRAEDTAVYYCAKELGYFDYWGRGTLVTVSS

SEQ ID NO: 9854 - protein, 115 aa, Artificial Sequence
  Description of Artificial Sequence: Synthetic polypeptide
EVQLLESGGGLVQPGGSLRLSCAASGFTFEWYEMQWVRRAPGGLEWVSAISGDGWRTYYADSVKGRFTISRDNSKNTLYLQMNSLRAEDTAVYYCAKELGYFDYWGRGTLVTVSS

SEQ ID NO: 9855 - protein, 115 aa, Artificial Sequence
  Description of Artificial Sequence: Synthetic polypeptide
EVQLLESGGGLVQPGGSLRLSCAASGFTFGWYEMQWVRRAPGGLEWVSAISGDGYRTYYADSVKGRFTISRDNSKNTLYLQMNSLRAEDTAVYYCAKELLYFDYWGRGTLVTVSS

SEQ ID NO: 9856 - protein, 116 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELGFFDYWGRGTLVTVSS

SEQ ID NO: 9857 - protein, 114 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSNTLYLQMNSLRAEDTAVYYCAELEYFDYWGRGTLVTVSS

SEQ ID NO: 9858 - protein, 114 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSKNTLYLQMNSLAEDTAVYYCAGLEYFDYWGRGTLVTVSS

SEQ ID NO: 9859 - protein, 114 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSNTLYLQMNSLRAEDTAVYYCAELAFFDYWGRGTLVTVSS

SEQ ID NO: 9860 - protein, 115 aa, Artificial Sequence
  Description of Artificial Sequence: Synthetic polypeptide
EVQLLESGGGLVQPGGSLRLSCAASGFTFEWYEMQWVRRAPGGLEWVSAISGDGYRTYYADSVKGRFTISRDNSKNTLYLQMNSLRAEDTAVYYCAKELLYFDYWGRGTLVTVSS

SEQ ID NO: 9861 - protein, 114 aa, Artificial Sequence
  Description of Artificial Sequence: Synthetic polypeptide
EVQLLESGGGLVQPGGSLRLSCAASGFTFEYEMQWVRRAPGKGLEWVSAISGDGYRTYYADSVGRFTISRDNSKNTLYLQMNSLRAEDTAVYYCAKELEFFDYWGRGTLVTVSS

SEQ ID NO: 9862 - protein, 113 aa, Artificial Sequence
  Description of Artificial Sequence: Synthetic polypeptide
EVQLLESGGGLVQPGGSLRLSCAASGFTFEWYEMQVRRAPGKGLEWVSAISGDGYRTYYADSVKGRFTISRDNSNTLYLQMNSLAEDTAVYYCAKELQFFDYWGRGTLVTVSS

SEQ ID NO: 9863 - protein, 115 aa, Artificial Sequence
  Description of Artificial Sequence: Synthetic polypeptide
EVQLLESGGGLVQPGGSLRLSCAASGFTFPKNEMTWVRQAPGKGLEVSAIESDGQATYYADSVGRFTISRDNSNTLYLQMNSLRAEDTAVYYCAKNRIPDLVFDYGQGTLVTVSS

SEQ ID NO: 9864 - protein, 115 aa, Artificial Sequence
  Description of Artificial Sequence: Synthetic polypeptide
EVQLLESGGGLVQPGGSLRLSCAASGFTFEWYEMQWVRRAPGKGLEWVSAISGDGYRTYYADSVKGRFTISRDNSNTLYLQMNSLRAEDTAVYYCAKELLFFDYWGRGTLVTVSS

SEQ ID NO: 9865 - protein, 114 aa, Artificial Sequence
  Description of Artificial Sequence: Synthetic polypeptide
EVQLLESGGGLVRPGGSLRLSCAASGFTFEWYEMQWVRRAPGKGLEWVSAISGDGYRTYYADSVKGRFTISRDNSKNTLYLQMNSLAEDTAVYYCAELEFFDYWGRGTLVTVSS

SEQ ID NO: 9866 - protein, 114 aa, Artificial Sequence
  Description of Artificial Sequence: Synthetic polypeptide
EVQLLESGGGLVQPGGSLRLSCAASGFTFEWYEMQWVRRAPGGLEWVSAISGDGYRTYYADSVGRFTISRDNSKNTLYLQMNSLRAEDTAVYYCAKELLFFDYRGRGTLVTVSS

SEQ ID NO: 9867 - protein, 114 aa, Artificial Sequence
  Description of Artificial Sequence: Synthetic polypeptide
EVQLLESGGGLVQPGGSLRLSCAASGFIFEWYEMQWVRRAPGKGLEWVSAISGDGYRTYTADSVGRFTISRDNSKNTLYLQMNSLRAEDTAVYYCAKLEYFDYWGRGTLVTVSS

SEQ ID NO: 9868 - protein, 116 aa, Artificial Sequence
  Description of Artificial Sequence: Synthetic polypeptide
EVRLLESGGGLVQPGGSLRLSCAASGFTFEWYEMQWVRRAPGKGLEWVSAISGDGYRTYYADSVKGRFTISRDNSKNTLYLQMNSLRAEDTAVYYCAKELQFFDYWGRGTLVTVSS

SEQ ID NO: 9869 - protein, 115 aa, Artificial Sequence
  Description of Artificial Sequence: Synthetic polypeptide
EVQLLGSGGGLVQPGGSLRLSCAASGFTFEEEEMIWVRQAPGKGLEWVSAISGSGGSTYYADSVKGRFTISRDNSKNTLYLQMNSLRAEDTAVYYCSKEPFRFDYGQGTLVTVSS

SEQ ID NO: 9870 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFRYDYWGQGTLVTVSS

SEQ ID NO: 9871 - protein, 114 aa, Artificial Sequence
  Description of Artificial Sequence: Synthetic polypeptide
EVQLLASGGGLVQPGGSLRLSCAASGFTFEEEEMIWVRQAPGKGLEWISAISGSGGSTYYADSVGRFTISRDNSKNTLYLQMNSLRAEDTAVYYCGKEPFRFDYGQGTLVTVSS

SEQ ID NO: 9872 - protein, 115 aa, Artificial Sequence
  Description of Artificial Sequence: Synthetic polypeptide
EVQLLDPGGGLVQPGGSLRLSCAASGFTFGKEEMIWVRQAPGKGLEWVSSISGSGGSTYYADSVKGRFTISRDNSRNTLYLQMNSLRAEDTAVYYCGEPFRFDYWGQGTLVTVSS

SEQ ID NO: 9873 - protein, 116 aa, Artificial Sequence
  Description of Artificial Sequence: Synthetic polypeptide
EVQLLGSGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFRFDYWGQGTLVTVSS

SEQ ID NO: 9874 - protein, 117 aa, Artificial Sequence
  Description of Artificial Sequence: Synthetic polypeptide
EVQLLESGGGLVQPGGSLRLSCAASGFTFDAGAHTWVRQAPGKGLEWVSSIDKEGLSTYYADSVGRFTISRDNSNTLYLQMNSLRAEDTAVYYCAKGRIPGLVFDYWGQGTLVTVSS

SEQ ID NO: 9875 - protein, 116 aa, Artificial Sequence
  Description of Artificial Sequence: Synthetic polypeptide
EVQLLEPGGGLVQPGGSLRLSCAASGFTFEEEEMIWVRQAPGKGLEWVSAISGSGGSTYYADSVKGRFTISRDNSKNTLYLLMNSLRAEDTAVYYCSKEPFRFDYWGQGALVTVSS

SEQ ID NO: 9876 - protein, 116 aa, Artificial Sequence
  Description of Artificial Sequence: Synthetic polypeptide
EVQLLDPGGGLVQPGGSLRLSCAASGFTFGKEEMIWVRQAPGKGLEWVSSISGSGGSTYYADSVKGRFTISRDNSKNTLYLQMNSLRAEDTAVYYCAKEPLRFDYWGQGTLVTVSS

SEQ ID NO: 9877 - protein, 114 aa, Artificial Sequence
  Description of Artificial Sequence: Synthetic polypeptide
EVQLLESGGGLVQPGGSLRLSCAASGFTFEEEEMIWVRQAPGKGLEWISAISGSGGSTYYADSVGRFTIHRDNSNTLYLQMNSLRAEDTAVYYCSKEPFRFDYRGLGTLVTVSS

SEQ ID NO: 9878 - protein, 116 aa, Artificial Sequence
  Description of Artificial Sequence: Synthetic polypeptide
EVQLLDPGGGLVQPGGSLRLSCAASGFTFGKEEMIWVRQAPGKGLEWVSSISGSGGSTYYADSVKGRFTISRDNSRNTLYLQMNSLRAEDTAVYYCAKEPLRFDYWGQGTLVTVSS

SEQ ID NO: 9879 - protein, 116 aa, Artificial Sequence
  Description of Artificial Sequence: Synthetic polypeptide
EVQLLDSGGGFVQPGGSLRLSCAASGFTFEEEEMIWVRQAPGKGLEWISAISGSGGSTYYADSVKGRFTISRDNSKNTLYLQMNSLRAEDTAVYYCAKEPFRFDYWGQGTLVTVSS

SEQ ID NO: 9880 - protein, 116 aa, Artificial Sequence
  Description of Artificial Sequence: Synthetic polypeptide
EVQLLDPGGGLVQPGGSLRLSCAASGFTFEEEEMIWVRQAPGKGLEWISAISGSGGSTYYADSVKGRFTISRDNSNNTLYLQMNSLRAEDTAVYYCGREPFRFDYWGQGTLVTVSS

SEQ ID NO: 9881 - protein, 115 aa, Artificial Sequence
  Description of Artificial Sequence: Synthetic polypeptide
EVRLLESGEGLVQPGGSLRLSCAASGFTFEEEEMIWVRQAPGKGLEWVSAISGSGGSTYYADSVKGRFTISRDNSKNTLYLQMNSLRAEDTAVYYCGKEPFRFDYGQGTLVTVSS

SEQ ID NO: 9882 - protein, 115 aa, Artificial Sequence
  Description of Artificial Sequence: Synthetic polypeptide
EVQQLESGGGLVQPGGSLRLSCAASGFTFEEEEMIWVRQAPGKGLEWVSAISGSGGSTYYADSVKGRFTISRDNSKNTLYLQMNSLRAEDTAVYYCGEPFRFDYWGQGTLVTVSS

SEQ ID NO: 9883 - protein, 115 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGEPFYYDYWGQGTLVTVSS

SEQ ID NO: 9884 - protein, 115 aa, Artificial Sequence
  Description of Artificial Sequence: Synthetic polypeptide
EVQLLASGGGLVQPGGSLRLSCAASGFTFEEEEMIWRQAPGKGLEWVSAISGSGGSTYYADSVKGRFTISRDNSKNTLYLQMNSLRAEDTAVYYCGKEPFYFDYWGQGTLVTVSS

SEQ ID NO: 9885 - protein, 119 aa, Artificial Sequence
  Description of Artificial Sequence: Synthetic polypeptide
EVQLLESGGGLVQPGGSLRLSCAASGFTFGDAAMTWVRQAPGKGLEWVSAIQPMGDGTYYADSVKGRFTVSRDNSKNTLYLQMNSLRAEDTAVYYCAKGRIPTLQFDYWGQGTLVTVSS

SEQ ID NO: 9886 - protein, 115 aa, Artificial Sequence
  Description of Artificial Sequence: Synthetic polypeptide
EVQLLASGGGLVQPGGSLRLSCAASGFTFEEKEMIWVRQAPGGLEWVSAISGSGGSTYYADSVKGRFTISRDNSKNTLYLQMNSLRAEDTAVYYCGKEPFFYDYWGQGTLVTVSS

SEQ ID NO: 9887 - protein, 114 aa, Artificial Sequence
  Description of Artificial Sequence: Synthetic polypeptide
EVQLLASGGGLVQPGGSLRLSCAASGFTFPQEEMIWVRQAPGGLEWVSAISGSGGSTYYADSVKGRFTISRDNSKNTLYLQMNSLRAEDTAVYYCGEPFRYDYWGQGTLVTVSS

SEQ ID NO: 9888 - protein, 114 aa, Artificial Sequence
  Description of Artificial Sequence: Synthetic polypeptide
EVQLLASGGGLVQPGGSLRLSCAASGFTFFAAEMIWVRQAPGGLEWVSAISGSGGSTYYADSVKGRFTISRDNSKNTLYLQMNSLRAEDTAVYYCGKEPFRYDYGQGTLVTVSS

SEQ ID NO: 9889 - protein, 114 aa, Artificial Sequence
  Description of Artificial Sequence: Synthetic polypeptide
EVQLLASGGGLVQPGGSLRLSCAASGFTFEEEEMIWVRQAPGKGLEWVSAISRPGTSTYYADSVGRFTISRDNSKNTLYLQMNSLRAEDTAVYYCGEPFRYDYWGQGTLVTVSS

SEQ ID NO: 9890 - protein, 114 aa, Artificial Sequence
  Description of Artificial Sequence: Synthetic polypeptide
EVQLLASGGGLVQPGGSLRLSCAASGFTFEEEEMIWVRQAPGKGLEWVSAISRMGFSTYYADSVGRFTISRDNSNTLYLQMNSLRAEDTAVYYCGKEPFRYDYWGQGTLVTVSS

SEQ ID NO: 9891 - protein, 115 aa, Artificial Sequence
  Description of Artificial Sequence: Synthetic polypeptide
EVQLLASGGGLVQPGGSLRLSCAASGFTFEEEEIWVRQAPGKGLEWVSAISRWGHSTYYADSVKGRFTISRDNSKNTLYLQMNSLRAEDTAVYYCGKEPFRYDYWGQGTLVTVSS

SEQ ID NO: 9892 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRLGWSTYYADSVKGRFTISRDNSKNTLYLQMNSLRAEDTAVYYCGKEPFRYDYWGQGTLVTVSS

SEQ ID NO: 9893 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGASTYYADSVKGRFTISRDNSKNTLYLQMNSLRAEDTAVYYCGKEPFRYDYWGQGTLVTVSS

SEQ ID NO: 9894 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRQGGSTYYADSVKGRFTISRDNSKNTLYLQMNSLRAEDTAVYYCGKEPFRYDYWGQGTLVTVSS

SEQ ID NO: 9895 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISVSGWSTYYADSVKGRFTISRDNSKNTLYLQMNSLRAEDTAVYYCGKEPFRYDYWGQGTLVTVSS

SEQ ID NO: 9896 - protein, 118 aa, Artificial Sequence
  Description of Artificial Sequence: Synthetic polypeptide
EVQLLESGGGLVQPGGSLRLSCAASGFTFEDSPMTWVRQAPGKGLEWVSAITSNGYETYYADSVKGRFTISRDNSNTLYLQMNSLRAEDTAVYYCAKGRIPTLHFDYWGQGTLVTVSS

SEQ ID NO: 9897 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGWSTYYADSVKGRFTISRDNSKNTLYLQMNSLRAEDTAVYYCGKEPFRYDYWGQGTLVTVSS

SEQ ID NO: 9898 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGLSTYYADSVKGRFTISRDNSKNTLYLQMNSLRAEDTAVYYCGKEPFRYDYWGQGTLVTVSS

SEQ ID NO: 9899 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGLGWSTYYADSVKGRFTISRDNSKNTLYLQMNSLRAEDTAVYYCGKEPFRYDYWGQGTLVTVSS

SEQ ID NO: 9900 - protein, 115 aa, Artificial Sequence
  Description of Artificial Sequence: Synthetic polypeptide
EVQLLASGGGLVQPGGSLRLSCAASGFTFEEEEMIWVRQAPGKGLEWVSAISALGWSTYYADSVKGRFTISRDNSKNTLYLQMNSLRAEDTAYYCGKEPFRYDYWGQGTLVTVSS

SEQ ID NO: 9901 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRRGYSTYYADSVKGRFTISRDNSKNTLYLQMNSLRAEDTAVYYCGKEPFRYDYWGQGTLVTVSS

SEQ ID NO: 9902 - protein, 113 aa, Artificial Sequence
  Description of Artificial Sequence: Synthetic polypeptide
EVQLLASGGGLVQPGGSLRLSCAASGFTFEEEEMIWVRQAPGGLEWVSAISRHGWSTYYADSVKGRFTISRDNSNTLYLQMNSLRAEDTAYYCGKEPFRYDYWGQGTLVTVSS

SEQ ID NO: 9903 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSSISRSGGSTYYADSVKGRFTISRDNSKNTLYLQMNSLRAEDTAVYYCGKEPFRYDYWGQGTLVTVSS

SEQ ID NO: 9904 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRIGNSTYYADSVKGRFTISRDNSKNTLYLQMNSLRAEDTAVYYCGKEPFRYDYWGQGTLVTVSS

SEQ ID NO: 9905 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGHGWSTYYADSVKGRFTISRDNSKNTLYLQMNSLRAEDTAVYYCGKEPFRYDYWGQGTLVTVSS

SEQ ID NO: 9906 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRWGGSTYYADSVKGRFTISRDNSKNTLYLQMNSLRAEDTAVYYCGKEPFRYDYWGQGTLVTVSS

SEQ ID NO: 9907 - protein, 118 aa, Artificial Sequence
  Description of Artificial Sequence: Synthetic polypeptide
EVQLLESGGGLVQPGGSLRLSCAASGFTFDEHDMSWVRQAPGKGLEWVSRIGPDGFHTYYADSVGRFTISRDNSKNTLYLQMNSLRAEDTAVYYCAKGRIPTLHFDYWGQGTLVTVSS

SEQ ID NO: 9908 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFMYDYWGQGTLVTVSS

SEQ ID NO: 9909 - protein, 115 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPFPDYWGQGTLVTVSS

SEQ ID NO: 9910 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGGTYYADSVKGRFTISRDNSKNTLYLQMNSLRAEDTAVYYCGKEPFRYDYWGQGTLVTVSS

SEQ ID NO: 9911 - protein, 114 aa, Artificial Sequence
  Description of Artificial Sequence: Synthetic polypeptide
EVQLLASGGGLVQPGGSLRLSCAASGFTFEEEEMIWVRQAPGGLEWVSAISGSGGSTYYADSVKGRFTISRDNSNTLYLQMNSLRAEDTAVYYCGKEPLYYDYWGQGTLVTVSS

SEQ ID NO: 9912 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISGSGGSTYYADSVKGRFTISRDNSKNTLYLQMNSLRAEDTAVYYCGKEPMYYDYWGQGTLVTVSS

SEQ ID NO: 9913 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGFSTYYADSVKGRFTISRDNSKNTLYLQMNSLRAEDTAVYYCGKEPFRYDYWGQGTLVTVSS

SEQ ID NO: 9914 - protein, 113 aa, Artificial Sequence
  Description of Artificial Sequence: Synthetic polypeptide
EVQLLASGGGLVQPGGSLRLSCAASGFTFEEEEMIWVRQAPGKGLEVSAISRTGGSTYYADSVKGRFTISRDNSNTLYLQMNSLRAEDTAVYYCGEPFRYDYWGQGTLVTVSS

SEQ ID NO: 9915 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISREGGSTYYADSVKGRFTISRDNSKNTLYLQMNSLRAEDTAVYYCGKEPFRYDYWGQGTLVTVSS

SEQ ID NO: 9916 - protein, 116 aa, Artificial Sequence
  Description of Artificial Sequence: Synthetic polypeptide
EVQLLASGGGLVQPGGSLRLSCAASGFPFEEEEMIWVRQAPGKGLEWVSAISRQGWSTYYADSVKGRFTISRDNSKNTLYLQMNSLRAEDTAVYYCGKEPFRYDYWGQGTLVTVSS

SEQ ID NO: 9917 - protein, 115 aa, Artificial Sequence
  Description of Artificial Sequence: Synthetic polypeptide
EVQLLASGGGLVQPGGSLRLSCAASGFTFEEEEMIWVRQAPGKGLEWVSAISRGGGSTYYADSVKGRFTISRDNSKNTLYLQMNSLRAEDTAVYYCGKEPFRYDYWGQGTLTVSS

SEQ ID NO: 9918 - protein, 118 aa, Artificial Sequence
  Description of Artificial Sequence: Synthetic polypeptide
EVQLLESGGGLVQPGGSLRLSCAASGFTFGEYHMSWVRQAPGKGLEWVSRITPLGTLTYYADSVKGRFTISRDNSKNTLYLQMNSLRAEDTAVYYCAGRIPSLTFDYWGQGTLVTVSS

SEQ ID NO: 9919 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRTGYSTYYADSVKGRFTISRDNSKNTLYLQMNSLRAEDTAVYYCGKEPFRYDYWGQGTLVTVSS

SEQ ID NO: 9920 - protein, 114 aa, Artificial Sequence
  Description of Artificial Sequence: Synthetic polypeptide
EVQLLASGGGLVQPGGSLRLSCAASGFTFEEEEMIWVRQAPGGLEWVSAISRNGRSTYYADSVKGRFTISRDNSKNTLYLQMNSLRAEDTAVYYCGEPFRYDYWGQGTLVTVSS

SEQ ID NO: 9921 - protein, 114 aa, Artificial Sequence
  Description of Artificial Sequence: Synthetic polypeptide
EVQLLASGGGLVQPGGSLRLSCAASGFTFEEEEMIWVRQAPGKGLEVSAISRNGYSTYYADSVGRFTISRDWSKNTLYLQMNSLRAEDTAVYYCGKEPFRYDYWGQGTLVTVSS

SEQ ID NO: 9922 - protein, 115 aa, Artificial Sequence
  Description of Artificial Sequence: Synthetic polypeptide
EVQLLASGGGLVQPGGSLRLSCAASGFTFEEEEMIWVRQAPGKGLEWVSAISRKGSSTYYADSVKGRFTISRDNSKNTLYLQMNSLRAEDTAVYYCGEPFRYDYWGQGTLVTVSS

SEQ ID NO: 9923 - protein, 115 aa, Artificial Sequence
  Description of Artificial Sequence: Synthetic polypeptide
EVQLLASGGGLVQPGGSLRLSCAASGFTFEEEEMIWVRQAPGKGLEWVSAISRGGSTYYADSVKGRFTISRDNSKNTLYLQMNSLRAEDTAVYYCGKEPFRYDYWGQGTLVTVSS

SEQ ID NO: 9924 - protein, 113 aa, Artificial Sequence
  Description of Artificial Sequence: Synthetic polypeptide
EVQLLASGGGLVQPGGSLRLSCAASGFTFEEEEMIWVRQAPGGLEWVSAISRSGYSTYYADSVKGRFTISRDNSKNTLYLQMNSLRAEDTAVYYCGEFRYDYWGQGTLVTVSS

SEQ ID NO: 9925 - protein, 116 aa, Artificial Sequence
  Description of Artificial Sequence: Synthetic polypeptide
EVQLLASGGGLVQPGGSLRLSCAASGFTFEEEEMIWVRQAPGKGLEWVSAISRNGMSTYYADSVKGRFTISRDNSKNTLYLQMNSLRAEDTAVYYCGKEPFRYDYWGQGTLVTVSS

SEQ ID NO: 9926 - protein, 116 aa, Artificial Sequence
  Description of Artificial Sequence: Synthetic polypeptide
EVQLLESGGGLVQPGGSLRLSCAASGFTFEEEEMIWVRQAPGKGLEWVSAISRNGYSTYYADSVKGRFTISRDNSKNTLYLQHNSLRAEDTAVYYCGKEPFRYDYWGQGTLVTVSS

SEQ ID NO: 9927 - protein, 112 aa, Artificial Sequence
  Description of Artificial Sequence: Synthetic polypeptide
EVQLLESGEGLVQPGGSLRLSCAASGFTFTEHEMIWVRQAPGGLEWVSSISGNGANTYYADSVKGRFTISRDNSKNTLYLQMNSLRPEDTAVYYCAKEPLFDYGQGTLTVSS

SEQ ID NO: 9928 - protein, 112 aa, Artificial Sequence
  Description of Artificial Sequence: Synthetic polypeptide
EVQLLESGGGLVQPGGSLRLSCAASGSTFTEYEMIWVRQAPGKGLEISSISGNGANTYYADSVGRFTISRDNSKNTLYLQMSLAEDTAVYFCAKEPLRFDYRGQGTLVTVSS

SEQ ID NO: 9929 - protein, 118 aa, Artificial Sequence
  Description of Artificial Sequence: Synthetic polypeptide
EVQLLESGGGLVQPGGSLRLSCAASGFTFGTNAMSWVRQAPGKGLEVSRISPGGDYTYYADSVKGRFTISRDNSKNTLYLQMNSLRAEDTAVYYCAKGRVPDLLFDYWGQGTLVTVSS

SEQ ID NO: 9930 - protein, 114 aa, Artificial Sequence
  Description of Artificial Sequence: Synthetic polypeptide
EVQLLEPGGGLVQPGGSLRLSCAASGFTFTEYEMIWVRKAPGKGMEWVSSISGNGANTYYADSVKGRFTISRDNSNMLYLQNSLRAEDTAVYYCAKEPLRFGYWGQGTLVTVSS

SEQ ID NO: 9931 - protein, 116 aa, Artificial Sequence
  Description of Artificial Sequence: Synthetic polypeptide
EVQLLDSGGGLVQPGGSLRLSCAASGFTFTEYEMIWVRQAPGKGLEWVSSISGNGANTYYADSVKGRFTISRDNSKNTLYLQMNSLRAEDTAVYYCAKEPLRFDYWGRGTLVTVSS

SEQ ID NO: 9932 - protein, 115 aa, Artificial Sequence
  Description of Artificial Sequence: Synthetic polypeptide
EVQLLGSGGGLVQPGGSLRLSCAASGFTFTEYEMIWVRQAPGKSLEWVSSISGNGANTYYADSVKGRFTISRDNSKNTLYLQMNSLRAEDTAVYYCAEPLRYDDWGQGTLVTVSS

SEQ ID NO: 9933 - protein, 116 aa, Artificial Sequence
  Description of Artificial Sequence: Synthetic polypeptide
EVQPLESGGGLVQPGGSLRLSCSASGFTFNEYEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 9934 - protein, 116 aa, Artificial Sequence
  Description of Artificial Sequence: Synthetic polypeptide
EVQLLESGEGLVQPGGSLRLSCAASGFTFAEYEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 9935 - protein, 116 aa, Artificial Sequence
  Description of Artificial Sequence: Synthetic polypeptide
EVQLLDPGGGLVQPGGSLRLSCAASGFTFTESEMIWVRQAPGKGLEWVSSISGNGANTYYADSVKGRFTISRDNSKNTLYLQMNSLRAEDTAVYYCAKEPLRFDYWGQGTLVTVSS

SEQ ID NO: 9936 - protein, 113 aa, Artificial Sequence
  Description of Artificial Sequence: Synthetic polypeptide
EVQLLEPGGGLVQPGGSLRLSCAASGFTFTEYEMIWVRAPGKGMEWVSSISGNGANTYYADSVGRFTISRDNSKNTLYLQMNSLRPEDTAVYYCAEPLRFDDWGQGTLVTVSS

SEQ ID NO: 9937 - protein, 115 aa, Artificial Sequence
  Description of Artificial Sequence: Synthetic polypeptide
EVQLLESGVGLVQPGGSLRLSCAASGFTFTEYEMIWVRKAPGKGLEWVSSISGNGANTYYADSVGRFTISRDNSKNTLYLQMNSLRAEDTAVYYCAKEPLRFDNWGQGTLVTVSS

SEQ ID NO: 9938 - protein, 116 aa, Artificial Sequence
  Description of Artificial Sequence: Synthetic polypeptide
EVQLLESRGGLVQPGGSLRLSCAASGFTFTEHEMIWVRQAPGKGLEWVSSISGNGANTYYADSVKGRFSVSRDNSKNTLYLQMNSLRAEDTAVYYCAKEPLRFDYWGQGTLVTVSS

SEQ ID NO: 9939 - protein, 113 aa, Artificial Sequence
  Description of Artificial Sequence: Synthetic polypeptide
EVQPLESGGGLVQPGGSLRLSCAASGFTFTEYEMIVRQAPGGLEWVSSISGNGANTYYADSVKGRFTISRDNSKNTLYLQMNSLRAEDTAVYYCAKEPLRFDYGQGTLVTVSS

SEQ ID NO: 9940 - protein, 118 aa, Artificial Sequence
  Description of Artificial Sequence: Synthetic polypeptide
EVQLLESGGGLVQPGGSLRLSCAASGFTFPSEEMSWVRQAPGKGLEWVSRISADGANTYYADSVKGRFTISRDNSKNTLYLQMNSLRAEDAAVYYCAKGRVPDLLFDYGQGTLVTVSS

SEQ ID NO: 9941 - protein, 115 aa, Artificial Sequence
  Description of Artificial Sequence: Synthetic polypeptide
EVQLLESAGGLVQPGGSLRLSCAASGFTFAEYEMIWVRQAPGKGLEWVSSISGNGANTYYADSVKGRFTISRDNSKNTLYLQMNSLRAEDTAVYYCAKEPLRFDYWGQGALVTSS

SEQ ID NO: 9942 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDLRYARFDYSGQGTLVTVSS

SEQ ID NO: 9943 - protein, 122 aa, Artificial Sequence
  Description of Artificial Sequence: Synthetic polypeptide
EEQLLESGGGLVQPGGSLRLSCTASGFTFNMYEMSWVRQAPGKGLEVSGISRRGFTTYYADSVKGRFTISRDNSKNTLYLQMNSLRAEDTAVYYCAKEPITYATRYARFDYWGQGTLVTVSS

SEQ ID NO: 9944 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNFKNTLYLQMNSLRAEDTAVYYCAKEPITYDMRYARFDYGGQGTLVTVSS

SEQ ID NO: 9945 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDMRYARFDNWGQGTLVTVSN

SEQ ID NO: 9946 - protein, 120 aa, Artificial Sequence
  Description of Artificial Sequence: Synthetic polypeptide
EVQLMESGGGLVQPGGSLRLSCTASGFSFNMYEMSWVRQAPGKGLEWVSGISRRGYTTYYADSVGRFTISRDNSKNTLYLQMNSLRAEDTAVYYCAKEPITYDMYARFDYWGRGTLTVSS

SEQ ID NO: 9947 - protein, 123 aa, Artificial Sequence
  Description of Artificial Sequence: Synthetic polypeptide
EVQLLESGGGLVQPGGSLRLSCTASGFAFNMYEMSWVRQAPGKGLEWVSGISRHGFTTYYADSVKGRFTVSRDNSKNTLYLQMNSLRAEDTAVYYCAKEPITYDMRYARSDYWGQGTLVTVSS

SEQ ID NO: 9948 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYFCAKEPITYDMRYARSDYWGQGTLVTVSS

SEQ ID NO: 9949 - protein, 122 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYSMRYAFDYSGLGTMVTVSS

SEQ ID NO: 9950 - protein, 123 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVKGRFTISRDNSKNTLYLQMNSLRAEDTAVYYCAKEPITYDMRYARFDYSGQGTLVTVSS

SEQ ID NO: 9951 - protein, 120 aa, Artificial Sequence
  Description of Artificial Sequence: Synthetic polypeptide
EVQLLESGGGLVQPGGSLRLSCTASGFTFNMYEMSWVRKAPGGLEWVSGISRHGFTTYYADSVKGRFTISRDNSNTLYLQMNSLRAEDTAVYYCAKEPITYDMRYARFDYGQGTLVTVSS

SEQ ID NO: 9952 - protein, 120 aa, Artificial Sequence
  Description of Artificial Sequence: Synthetic polypeptide
EVQLFESGGGLVQPGGSLRLSCTASGFTFNMYEMSWVRQAPGGLEWVSGISRRGFTTYYADSVGRFTISRDNSNTLYLQMNSLRAEDTAVYYCAKEPITYDMRYARFDYWGRGTLVTVSS

SEQ ID NO: 9953 - protein, 121 aa, Artificial Sequence
  Description of Artificial Sequence: Synthetic polypeptide
EVQLLESGGGLVQPGGSLRLSCTASGFTFNMYEMSWVRQAPGKGLEWVSGISRRGFTTYYADSVGRFTISRDNSNTLYLQMNSLRAEDTAVYYCAKEPITYDMRYARFDYWGRGTLVTVSS

SEQ ID NO: 9954 - protein, 120 aa, Artificial Sequence
  Description of Artificial Sequence: Synthetic polypeptide
EVQLLESGGGSVQPGGSLRLSCTASGFSFNMYEMSWVRQAPGGLEWVSGISRRGFTTYYADSVKGRFTISRDNSNTLYLQMNSLRAEDTAVYYCAEPITYDMRYARFDYWGQGTLVTVSG

SEQ ID NO: 9955 - protein, 121 aa, Artificial Sequence
  Description of Artificial Sequence: Synthetic polypeptide
EVQLLESGGGLVQPGGSLRLSCTASGFTFNMYEMSWVRAPGKGLEWVSGISRRGFTTYYADSVGRFTISRDNSKNTLYLQMNSLRAEDTAVYYCAKEPITYDMRYARFDYWGQGTLVTVSS

SEQ ID NO: 9956 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYYCALPFTFEDWGQGTLVTVSS

SEQ ID NO: 9957 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFTFDDWGQGTLVTVSS

SEQ ID NO: 9958 - protein, 115 aa, Artificial Sequence
  Description of Artificial Sequence: Synthetic polypeptide
EVQLLESGGGLVQPGGSLLSCAASGFTFRDYEMWWVRQAPGKGLERVSAINPQGTRTYYADSVKGRFTISRDNSKNTLYLQMNSLRAEDTAVYYCTKLPFIFEYWGQGTLVTVSS

SEQ ID NO: 9959 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFMFDDRGQGTLVTVSS

SEQ ID NO: 9960 - protein, 112 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYALFTFDDWGQGTLVTSS

SEQ ID NO: 9961 - protein, 116 aa, Artificial Sequence
  Description of Artificial Sequence: Synthetic polypeptide
EVQLLESGGGLVQPGGSLRLSCAASGFSFRDYEMWWYRQAPGKGLERVSAINPQGTRTYYADSVKGRFTISRDNSKNTLYLQMNSLRAEDTAVYYCAKLPFIFDNRGQGTLVTVSS

SEQ ID NO: 9962 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTSVYHCAKPPFIFGDWGPGTLVTVSS

SEQ ID NO: 9963 - protein, 115 aa, Artificial Sequence
  Description of Artificial Sequence: Synthetic polypeptide
EVQLLESGGGLVQPGGSRRLSCAASGFTFRDYEMWWVRQAPGKGLERVSAINPQGTRTYYADSVKGRFTISRDNSKNTLYLQMNSLRAEDTAVYYCAKLPFTFEDWGQGTLVTSS

SEQ ID NO: 9964 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFMFDDRGQGTLVTVSS

SEQ ID NO: 9965 - protein, 116 aa, Artificial Sequence
  Description of Artificial Sequence: Synthetic polypeptide
EVQLLESGGGLVQPGGSLRLSCAASGFTFRDYEMWWVRQAPGKVLERVSAINPQGTRTYYADSVKGRFTISRDNSKNMLYLQMNSLRAEDTAVYYCAKLPFMFDDRGQGTLVTVSS

SEQ ID NO: 9966 - protein, 116 aa, Artificial Sequence; identical to SEQ ID NO: 9959
  Description of Artificial Sequence: Synthetic polypeptide

SEQ ID NO: 9967 - protein, 116 aa, Artificial Sequence
  Description of Artificial Sequence: Synthetic polypeptide
EVQLLESGGGLIQPGGSLRLSCAASGFTFRDYEMWWVRQAPGKGLERVSAINPQGTRTYYADSVKGRFTISRDNSKNTLYLQMNSLRAEDTAVYYCLKLPFIFDYWGQGTLVTVSS

SEQ ID NO: 9968 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQNSLRADDTAVYHCTKLPFIFDYWGQGTLVTVSS

SEQ ID NO: 9969 - protein, 116 aa, Artificial Sequence
  Description of Artificial Sequence: Synthetic polypeptide
EVQLLESGGGLVQPGGSLRLSCAASGFTFRDYEMWWVRRAPGKGLERVSAINPQGTRTYYADSVKGRFTISRDNSKNTLYLQMNSLRAEDTAVYYCAKLPFTFEDWGQGTLVTVSS

SEQ ID NO: 9970 - protein, 114 aa, Artificial Sequence
  Description of Artificial Sequence: Synthetic polypeptide
EVQLLESGGGLVQPGGSLRLSCAASGFTFRDYEMWVRQAPGGLERVSAINPQGTRTYYADSVMGRFTISRDNSKNTLYLQMNSLRAEDTAVYYCAKLPFTFEDWGQGTLVTVSS

SEQ ID NO: 9971 - protein, 113 aa, Artificial Sequence
  Description of Artificial Sequence: Synthetic polypeptide
EVQLLESGGGLVQPGGSLRLSCAASGFSFRDYEMWYRQAPGKGLERVSAINPQGTRTYYADSVGRFTISRDNSKNTLYLQMNSLRAEDTAVYYCAKLPFTFEDGQGTLVTVSS

SEQ ID NO: 9972 - protein, 114 aa, Artificial Sequence
  Description of Artificial Sequence: Synthetic polypeptide
EVQLLESGGGLVQPGGSLRLSCAASGFTFRDYEMWWVRQAPGKVLERVSAINPQGTRTYYADSVGRFTISRDNSNMLYLQMNSLRAEDTAVYYCAKLPFTFEDWGQGTLVTVSS

SEQ ID NO: 9973 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYHCAKLPFTFEDWGQGTLVTVSS

SEQ ID NO: 9974 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSNTLYLQMNSLRAEDTAVYYCTKLPFTFEDWGQGTLVTVSS

SEQ ID NO: 9975 - protein, 116 aa, Artificial Sequence
  Description of Artificial Sequence: Synthetic polypeptide
  MOD_RES (106)..(106): Selenocysteine
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCLKLPFTFEDXGQGTLVTVSS

SEQ ID NO: 9976 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQHNSLRADDTAVYHCTKLPFIFEYWGQGTLVTVSS

SEQ ID NO: 9977 - protein, 113 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVMGRFTISRDNSNTLYLQMNSLRAEDTAVYYCAKEPYSFDSGQGTLVTVSS

SEQ ID NO: 9978 - protein, 116 aa, Artificial Sequence
  Description of Artificial Sequence: Synthetic polypeptide
EVQLLESGGGLVQPGGSLRLSCAASGFTFRDYEMWWVRQAPGMVLERVSAINPQGTRTYYADSVKGRFTISRDNSKNTLYLQMNSLRAEDTAVYYCAKLPFFFDSRGQGTLVTVSS

SEQ ID NO: 9979 - protein, 113 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVMGRFTISRDNSNTLYLQMNSLRAEDTAVYHCAEPYSYDYWGQGTLVTVSS

SEQ ID NO: 9980 - protein, 116 aa, Artificial Sequence
  Description of Artificial Sequence: Synthetic polypeptide
EVQLLESGGGLVQPGGSLRLSCAASGFTFRDYEMWWVRRAPGKGLERVSAINPQGTRTYYADSVMGRFTISRDNSKNTLYLQMNSLRAEDTAVYYCAKLPFTFDDWGQGTLVTVSS

SEQ ID NO: 9981 - protein, 115 aa, Artificial Sequence
  Description of Artificial Sequence: Synthetic polypeptide
EVQLLESGGGLVQPGGSLRLSCAASGFTFRDYEMWVRRAPGKGLERVSAINPQGTRTYYADSVMGRFTISRDNSKNTLYLQMNSLRAEDTAVYYCAKLPFMFDDRGQGTLVTVSS

SEQ ID NO: 9982 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVMGRFTISRDNSKNTLYLQMNSLRAEDTAVYYCAKLPFMFDDWGQGTLVTVSS

SEQ ID NO: 9983 - protein, 115 aa, Artificial Sequence
  Description of Artificial Sequence: Synthetic polypeptide
EVQLLESGGGLVQPGGSLRLSCAASGFTFAGYELWWVRQAPGKGLERVSAINPQGTRTYYADSVMGRFTISRDNSKNTLYLQMNSLRAEDTAVYYCALPFTFDDWGQGTLVTVSS

SEQ ID NO: 9984 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAINPQGTRTYYADSVMGRFTISRDNSKNTLYLQMNSLRAEDTAVYYCAKLPFMFDDRGQGTLVTVSS

SEQ ID NO: 9985 - protein, 114 aa, Artificial Sequence
  Description of Artificial Sequence: Synthetic polypeptide
EVQLLESGGGLVQPGGSLRLSCAASGFTFAGYEWWFRQAPGKGLERVSAINPQGTRTYYADSVMGRFTISRDNSKNTLYLQMNSLRAEDTAVYYCALPFTFDDWGQGTLVTVSS

SEQ ID NO: 9986 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAINPQGTRTYYADSVMGRFTISRDNSKNTLYLQMNSLRAEDTAVYYCAKLPFMFDDRGQGTLVTVSS

SEQ ID NO: 9987 - protein, 115 aa, Artificial Sequence
  Description of Artificial Sequence: Synthetic polypeptide
EVQLLESGGGLVQPGGSLRLSCAASGFTFRDYEMWWVRQAPGKGLEWVSAINPQGTRTYYADSVMGRFTISRDNSKNTLYLQMNSLRAEDTAVYYCALPFTFDDWGQGTLVTVSS

SEQ ID NO: 9988 - protein, 116 aa, Artificial Sequence
  Description of Artificial Sequence: Synthetic polypeptide
EVQLLESGGGLVQPGGSLRLSCAASGFTFRDYEMWWVRQAPGKGLEWVSAINPQGTRTYYADSVMGRFTISRDNSKNTLYLQMNSLRAEDTAVYYCAKLPFMFDDRGQGTLVTVSS

SEQ ID NO: 9989 - protein, 112 aa, Artificial Sequence
  Description of Artificial Sequence: Synthetic polypeptide
EVQLLESGGGLVQPGGSLRLSCAASGFTFRDYEMVRQAPGKGLERVSAINPQGTRTYYADSVGRFTISRDNSNTLYLQMNSLRAEDTAVYYCAKLPTYFSDRGQGTLVTVSS

SEQ ID NO: 9990 - protein, 112 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVKGRFTISRDNSNTLYLQMNSLRAEDTAVYYCALPFFFEEGQGTLVTVSS

SEQ ID NO: 9991 - protein, 114 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVKGRFTISRDNSKNTLYLQMNSLRAEDTAVYYCALPTYFKDWGQGTLVTVSS

SEQ ID NO: 9992 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYYCAKLPFYFSEWGQGTLVTVSS

SEQ ID NO: 9993 - protein, 112 aa, Artificial Sequence
  Description of Artificial Sequence: Synthetic polypeptide
EVQLLESGGGLVQPGGSLRLSCAASGFTFRDYEMVRQAPGKGLERVSAINPQGTRTYYADSVKGRFTISRDNSNTLYLQMNSLRAEDTAVYHCALPMFFEDWGQGTLVTVSN

SEQ ID NO: 9994 - protein, 115 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVKGRFTISRDNSKNTLYLQHNSLRAEDTAVYYCAKLPFPFSEWGQGTLVTVSS

SEQ ID NO: 9995 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMDSLRAEDTAVYYCAKLPFYFSEWGQGTLVTVSS

SEQ ID NO: 9996 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPYGNLTYYADSVKGRFTISRDNSKNTLYLQMNSLRAEDTAVYYCALPFTFEDWGQGTLVTVSS

SEQ ID NO: 9997 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPPGTLTYYADSVKGRFTISRDNSKNTLYLQMNSLRAEDTAVYYCAKLPFTFEDRGQGTLVTVSS

SEQ ID NO: 9998 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCAKLPFTFEDWGQGTLVTVSS

SEQ ID NO: 9999 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPMGGFTYYADSVKGRFTISRDNSKNTLYLQMNSLRAEDTAVYYCALPFTFEDWGQGTLVTVSS

SEQ ID NO: 10000 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSHTYYADSVKGRFTISRDNSKNTLYLQMNSLRAEDTAVYYCAKLPFTFEDWGQGTLVTVSS

SEQ ID NO: 10001 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPSGGLTYYADSVKGRFTISRDNSKNTLYLQMNSLRAEDTAVYYCAKLPFTFDDRGQGTLVTVSS

SEQ ID NO: 10002 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGSLTYYADSVKGRFTISRDNSKNTLYLQMNSLRAEDTAVYYCAKLPFTFDDWGQGTLVTVSS

SEQ ID NO: 10003 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGRLTYYADSVKGRFTISRDNSKNTLYLQMNSLRAEDTAVYYCAKLPFTFEDWGQGTLVTVSS

SEQ ID NO: 10004 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFTFEDWGQGTLVTVSS

SEQ ID NO: 10005 - protein, 116 aa, Artificial Sequence
  Description of Artificial Sequence: Synthetic polypeptide
EVQLLESGGGLVQPGGSLRLSCAASGFTFPDYEMWWVRQAPGKGLERVSAINPQGTRTYYADSVKGRFTISRDNSKNTLYLQMNSLRAEDTAVYHCAKLPFTFDDWGQGTLVTVSS

SEQ ID NO: 10006 - protein, 116 aa, Artificial Sequence
  Description of Artificial Sequence: Synthetic polypeptide
EVQLLESGGGLVQPGGSLRLSCADSGFTFPPVEMWWVRQAPGKGLERVSAINPQGTRTYYADSVKGRFTISRDNSKNTLYLQMNSLRAEDTAVYYCAKLPFTFEDWGQGTLVTVSS

SEQ ID NO: 10007 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGGLTYYADSVKGRFTISRDNSKNTLYLQMNSLRAEDTAVYYCAKLPFTFDDWGQGTLVTVSS

SEQ ID NO: 10008 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGMHTYYADSVKGRFTISRDNSKNTLYLQMNSLRAEDTAVYYCAKLPFTFEDWGQGTLVTVSS

SEQ ID NO: 10009 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPHGGYTYYADSVKGRFTISRDNSKNTLYLQMNSLRAEDTAVYYCAKLFTFEDWGQGTLVTVSS

SEQ ID NO: 10010 - protein, 116 aa, Artificial Sequence
  Description of Artificial Sequence: Synthetic polypeptide
EVQLLESGGGLVQPGGSLRLSCAASGFTFRDYEMWWVRQAPGRGLERVSAINPPGMLTYYADSVKGRFTISRDNSKNTLYLQMNSLRAEDTAVYYCAKLPFTFDDWGQGTLVTVSS

SEQ ID NO: 10011 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPWGQLTYYADSVGRFTISRDNSKNTLYLQMNSLAEDTAVYYCAKLPFTFEDWGQGTLVTVSS

SEQ ID NO: 10012 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPWGGYTYYADSVKGRFTISRDNSKNTLYLQMNSLRAEDTAVYYCAKLPFTFDDGQGTLVTVSS

SEQ ID NO: 10013 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPSGGLTYYADSVKGRFTISRDNSKNTLYLQMNSLRAEDTAVYYCAKLPFTFEDGQGTLVTVSS

SEQ ID NO: 10014 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPSGGLTYYADSVKGRFTISRDNSKNTLYLQMNSLRAEDTAVYYCAKLPFTFDDWGQGTLVTVSS

SEQ ID NO: 10015 - protein, 114 aa, Artificial Sequence
  Description of Artificial Sequence: Synthetic polypeptide
EVQLLESGGGLVQPGGSLRLSCAASGFTFRDYEMWVRQAPGKGLERVSAINPSGTLTYYADSVKGRFTISRDNSNTLYLQMNSLRAEDTAVYYCAKLPFTFEDWGQGTLVTVSS

SEQ ID NO: 10016 - protein, 115 aa, Artificial Sequence
  Description of Artificial Sequence: Synthetic polypeptide
EVQLLESGGGLVQPGGSLRLSCAASGFTFRDYEMWVRQAPGKGLERVSAINPYGSLTYYADSVKGRFTISRDNSKNTLYLQMNSLRAEDTAVYYCAKLPFTFDDWGQGTLVTVSS

SEQ ID NO: 10017 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGYTYYADSVKGRFTISRDNSKNTLYLQMNSLRAEDTAVYYCAKLPFTFEDWGQGTLVTVSS

SEQ ID NO: 10018 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGGLTYYADSVKGRFTISRDNSKNTLYLQMNSLRAEDTAVYYCAKLPFTFEDWGQGTLVTVSS

SEQ ID NO: 10019 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGTLTYYADSVKGRFTISRDNSRNTLYLQMNSLRAEDTAVYYCAKLPFTFDDWGQGTLVTVSS

SEQ ID NO: 10020 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPNGRLTYYADSVKGRFTISRDNSKNTLYLQMNSLRAEDTAVYYCAKLPFTFADWGQGTLVTVSS

SEQ ID NO: 10021 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGQLTYYADSVKGRFTISRDNSKNTLYLQMNSLRAEDTAVYYCAKLPFTFDDWGQGTLVTVSS

SEQ ID NO: 10022 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGGLTYYADSVKGRFTISRDNSKNTLYLQMNSLRAEDTAVYYCAKLPFTFDDWGQGTLVTVSS

SEQ ID NO: 10023 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGMLTYYADSVKGRFTISRDNSKNTLYLQMNSLRAEDTAVYYCAKLPFTFDDWGQGTLVTVSS

SEQ ID NO: 10024 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGTLTYYADSVKGRFTISRDNSKNTLYLQMNSLRAEDTAVYYCAKLPFTFEDWGQGTLVTVSS

SEQ ID NO: 10025 - protein, 114 aa, Artificial Sequence
  Description of Artificial Sequence: Synthetic polypeptide
EVQLLESGGGLVQPGGSLRLSCAASGFTFRDYEMWVRQAPGGLERVSAINPWGSLTYYADSVKGRFTISRDNSKNTLYLQMNSLRAEDTAVYYCAKLPFTFDDWGQGTLVTVSS

SEQ ID NO: 10026 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPYGGLTYYADSVGRFTISRDNSKNTLYLQMNSLRAEDTAVYYCAKLPFTFEDGQGTLVTVSS

SEQ ID NO: 10027 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGFLTYYADSVKGRFTISRDNSKNTLYLQMNSLRAEDTAVYYCAKLPFTFEDWGQGTLVTVSS

SEQ ID NO: 10028 - protein, 115 aa, Artificial Sequence
  Description of Artificial Sequence: Synthetic polypeptide
EVQLLESGGGLVQPGGSLRLSCAASGFTFRDYEMWVRQAPGKGLERVSAINPWGSHTYYADSVKGRFTISRDNSKNTLYLQMNSLRAEDTAVYYCAKLPFTFDDWGQGTLVTVSS

SEQ ID NO: 10029 - protein, 114 aa, Artificial Sequence
  Description of Artificial Sequence: Synthetic polypeptide
EVQLLESGGGLVRPGGSLRLSCAASGFTFRDYEMWVRQAPGKGLERVSAINPYGGLTYYADSVKGRFTISRDNSKNTLYLQMNSLRAEDTAVYYCAKLPFTFEDGQGTLVTVSS

SEQ ID NO: 10030 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFTFEDWGQGTLVTVSS

SEQ ID NO: 10031 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPGGLTYYADSVKGRFTISRDNSKNTLYLQMNSLRAEDTAVYYCAKLPFTFDDWGQGTLVTVSS

SEQ ID NO: 10032 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPYGGLTYYADSVKGRFTISRDNSKNTLYLQMDSLRAEDTAVYYCAKLPFTFEDGQGTLVTVSS

SEQ ID NO: 10033 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGTLTYYADSVKGRFTISRDNSKNTLYLQMNSLRAEDTAVYYCAKLPFTFEDWGQGTLVTVSS

SEQ ID NO: 10034 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPWGGYTYYADSVKGRFTISRDNSNTLYLQMNSLRAEDTAVYYCAKLPFTFEDWGRGTLVTVSS

SEQ ID NO: 10035 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPYGNLTYYADSVKGRFTISRDNSKNTLYLQMNSLRAEDTAVYYCAKLPFTFDDWGQGTLVTVSS

SEQ ID NO: 10036 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPHGGFTYYADSVKGRFTISRDNSKNTLYLQMNSLRAEDTAVYYCAKLPFTFEDWGQGTLVTVSS

SEQ ID NO: 10037 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGFYTYYADSVKGRFTISRDNSKNTLYLQMNSLRAEDTAVYYCAKLPFTFDDWGQGTLVTVSS

SEQ ID NO: 10038 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPAGGLTYYADSVKGRFTISRDNSKNTLYLQMNSLRAEDTAVYYCAKLPFTFDDWGQGTLVTVSS

SEQ ID NO: 10039 - protein, 115 aa, Artificial Sequence
  Description of Artificial Sequence: Synthetic polypeptide
EVQLLEPGGGLVQPGGSLRLSCAASGFTFTEYEMIWVRQAPGKGLEWVSSISGNGANTYYADSVKGRFTISRDNSKNTLYLQMNSLRAEDTAVYYCAKEPLRFDNGQGTLVTVSS

SEQ ID NO: 10040 - protein, 119 aa, Artificial Sequence
  Description of Artificial Sequence: Synthetic polypeptide
EVQLLESGGGLVQPGGSLRLSCTASGFTFNTYEMSWVRQAPGKGLEWVSGIGRRGFTTYYADSVGRFTISRDNSNTLYLQMNSLAEDTAVYYCAEPITYDLRYARFDYSGQGTLVTVSS

SEQ ID NO: 10041 - protein, 114 aa, Artificial Sequence
  Description of Artificial Sequence: Synthetic polypeptide
EVQLLESGGGLVQPGGSLRLSCAASGFAFRDYEMWWVRQAPGKGLERVSAINPHGSLTYYADSVKGRFTISRDNSKNTLYLQMNSLAEDTAVYYCALPFTFEDWGQGTLVTVSS

SEQ ID NO: 10042 - protein, 114 aa, Artificial Sequence
  Description of Artificial Sequence: Synthetic polypeptide
EVQLLESGGGLVQPGGSLRLSCAASGFTFRDYEMWVRQAPGGLERVSAINPAGGYTYYADSVKGRFTISRDNSKNTLYLQMNSLRAEDTAVYHCAKLPFTFEDWGQGTLVTVSS

SEQ ID NO: 10043 - protein, 113 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVGRFTISRDNSKNTLYLQMNSLRAEDTAVYYCAKLPFWFTEGQGTLVTVSS

SEQ ID NO: 10044 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYYCAKLPFMFSDRGQGTLVTVSS

SEQ ID NO: 10045 - protein, 114 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVKGRFTISRDNSNTLYLQMNSLRAEDTAVYYCAKLPFLFQEWGQGTLVTVSS

SEQ ID NO: 10046 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPTRFEDWGQGTLVTVSS

SEQ ID NO: 10047 - protein, 115 aa, Artificial Sequence
  Description of Artificial Sequence: Synthetic polypeptide
EVQLLESGSGLVQPGGSLRLSCAASGFTFRDYEMWWVRQAPGKGLERVSAINPQGTRTYYADSVGRFTISRDNSKNTLYLQMNSLRAEDTAVYYCAKLPFYFHEWGQGTLVTVSS

SEQ ID NO: 10048 - protein, 115 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVKGRFTISRDNSKNTLYLQMNSLRAEDTAVYYCGKEPFRYDYWGQGTLVTVSS

SEQ ID NO: 10049 - protein, 114 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVKGRFTISRDNSKNTLYLQMNSLRAEDTAVYYCALPTFFKDWGQGTLVTVSS

SEQ ID NO: 10050 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYYCAKLPFFFQEWGQGTLVTVSS

SEQ ID NO: 10051 - protein, 114 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVGRFTISRDNSKNTLYLQMNSLRAEDTAVYYCAKLPQLFHDRGQGTLVTVSS

SEQ ID NO: 10052 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPQLFEDWGQGTLVTVSS

SEQ ID NO: 10053 - protein, 114 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVGRFTISRDNSKNTLYLQMNSLRAEDTAVYHCAKLPFGFSEWGQGTLVTVSS

SEQ ID NO: 10054 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLAEDTAVYYCALPQLFQDWGQGTLVTVSS

SEQ ID NO: 10055 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYYCAKLPFFFHEWGQGTLVTVSS

SEQ ID NO: 10056 - protein, 113 aa, Artificial Sequence
  Description of Artificial Sequence: Synthetic polypeptide
EVQLLESGGGLVQPGGSLRLSCAASGFTFRDYEMWVRQAPGKGLERVSAINPQGTRTYYADSVKGRFTISRDNSKNTLYLQMNSLRAEDTAVYYCAKLPHYFDGQGTLVTVSS

SEQ ID NO: 10057 - protein, 114 aa, Artificial Sequence
  Description of Artificial Sequence: Synthetic polypeptide
EVQLLESGGGLVQSGGSLRLSCAASGFTFRDYEMWWVRQAPGKGLERVSAINPQGTRTYYADSVKGRFTISRDNSKNTLYLQMNSLRAEDTAVYYCALPFYFEEGQGTLVTVSS

SEQ ID NO: 10058 - protein, 115 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVKGRFTISRDNSKNTLYLQMNSLRAEDTAVYYCAKLPFRFSDRGQGTLVTVSS

SEQ ID NO: 10059 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVGRFTISRDNSKNTLYLQMNSLRAEDTAVYYCAKLPTLFQDWGQGTLVTVSS

SEQ ID NO: 10060 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTYYADSVKGRFTISRDNSKNTLYLQMNSLRAEDTAVYYCAKLPFWFQEWGQGTLVTVSS

SEQ ID NO: 10061 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPGSLTYYADSVKGRFTISRDNSNTLYLQMNSLRAEDTAVYYCAKLPFYFQEWGQGTLVTVSS

SEQ ID NO: 10062 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYHCAKLPMFFEDWGQGTLVTVSN

SEQ ID NO: 10063 - protein, 113 aa, Artificial Sequence
  Description of Artificial Sequence: Synthetic polypeptide
EVQLLESGGGLVQPGGSLRLSCAASGFTFRDYEMWVRQAPGGLERVSAINPWGSLTYYADSVKGRFTISRDNSKNTLYLQMNSLRAEDTAVYYCAKLPFYFHEGQGTLVTVSS

SEQ ID NO: 10064 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGSLTYYADSVKGRFTISRDNSKNTLYLQMNSLRAEDTAVYYCAKLPFFFQEWGQGTLVTVSS

SEQ ID NO: 10065 - protein, 115 aa, Artificial Sequence
  Description of Artificial Sequence: Synthetic polypeptide
EVQLLESGGGLVQPGGSLRLSCAASGFTFRDYEMWWVRQAPGGLERVSAINPWGSLTYYADSVKGRFTISRDNSKNTLYLQMNSLRAEDTAVYYCAKLPFFFHEWGQGTLVTVSS

SEQ ID NO: 10066 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSNTLYLQMNSLRAEDTAVYYCALPFYFQEWGQGTLVTVSS

SEQ ID NO: 10067 - protein, 113 aa, Artificial Sequence
  Description of Artificial Sequence: Synthetic polypeptide
EVQLLESGGGLVQPGGSLRLSCAASGFTFRDYEMWWVRQAPGGLERVSAINPGGFTYYADSVKGRFTISRDNSKNTLYLQIWSLRAEDTAVYHCALPMFFEDWGQGTLVTVSN

SEQ ID NO: 10068 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFYFHEWGQGTLVTVSS

SEQ ID NO: 10069 - protein, 114 aa, Artificial Sequence
  Description of Artificial Sequence: Synthetic polypeptide
EVQLLESGGGLVQPGGSLRLSCAASGFTFRDYEMWVRQAPGGLERVSAINPWGGFTYYADSVKGRFTISRDNSKNTLYLQMNSLRAEDTAVYYCAKLPFFFQEWGQGTLVTVSS

SEQ ID NO: 10070 - protein, 119 aa, Artificial Sequence
  Description of Artificial Sequence: Synthetic polypeptide
EVQLLESGGGLVQPGGSLRLSCAASGFTFHWEPMSWVRQAPGKGLEWVSRINSSGWDTYYADSVKGRFTISRDNSKNTLYLQMNSLRAEDTAVYYCAKGMVPNLVFDYWGQGTLVTVSS

SEQ ID NO: 10071 - protein, 114 aa, Artificial Sequence
  Description of Artificial Sequence: Synthetic polypeptide
EVQLLESGGGLVQPGGSLRLSCAASGFTFRDYEMWVRQAPGGLERVSAINPWGGLTYYADSVKGRFTISRDNSKNTLYLQMNSLRAEDTAVYYCAKLPFYFQEWGQGTLVTVSS

SEQ ID NO: 10072 - protein, 114 aa, Artificial Sequence
  Description of Artificial Sequence: Synthetic polypeptide
EVQLLESGGGLVQPGGSLRLSCAASGFTFRDYEMWWVRQAPGGLERVSAINPWGGLTYYADSVKGRFTISRDNSKNTLYLQMNSLAEDTAVYHCAKLPMFFEDWGQGTLVTVSN

SEQ ID NO: 10073 - protein, 115 aa, Artificial Sequence
  Description of Artificial Sequence: Synthetic polypeptide
EVQLLESGGGLVQPGGSLRLSCAASGFTFRDYEMWWVRQAPGKGLERVSAINPWGGLTYYADSVKGRFTISRDNSKNTLYLQMNSLRAEDTAVYYCALPFYFHEWGQGTLVTVSS

SEQ ID NO: 10074 - protein, 111 aa, Artificial Sequence
  Description of Artificial Sequence: Synthetic polypeptide
EVQLLESGGGLVQPGGSLRLSCAASGFTFRDYEMVRQAPGKGLERVSAINPWGGLTYYADSVGRFTISRDNSKNTLYLQMNSLRAEDTAVYYCALPFFFQEGQGTLVTVSS

SEQ ID NO: 10075 - protein, 115 aa, Artificial Sequence
  Description of Artificial Sequence: Synthetic polypeptide
EVQLLESGGGLVQPGGSLRLSCAASGFTFRDYEMWVRQAPGKGLERVSAINPWGGLTYYADSVKGRFTISRDNSKNTLYLQMNSLRAEDTAVYYCAKLPFFFHEWGQGTLVTVSS

SEQ ID NO: 10076 - protein, 115 aa, Artificial Sequence
  Description of Artificial Sequence: Synthetic polypeptide
EVQLLESGGGLVQPGGSLRLSCAASGFTFRDYEMWWVRQAPGGLERVSAINPQGTRTYYADSVKGRFTISRDNSKNTLYLQMNSLRAEDTAVYHCAKLPMFFEDWGQGTLVTVSS

SEQ ID NO: 10077 - protein, 118 aa, Artificial Sequence
  Description of Artificial Sequence: Synthetic polypeptide
EVQLLETGGGLVQPGGSLRLSCAASGFTFSTYHMQWVRRAPGKGLEVSMIDADGLGTYYADPVKGRFTISRDNSKMTLYLQMNSLRAKDTAVYYCARPGPQFGQFDYLGQGTLVTVSS

SEQ ID NO: 10078 - protein, 119 aa, Artificial Sequence
  Description of Artificial Sequence: Synthetic polypeptide
EVQLFESGGGLVQTGGSLRLSCAASGFTFSTYHMQWVRQAPGKGLEWVSMIDADGLGKYYADPVKGRFTISRDNSKNTLYLQMNSLRAEDTAVYYCVKPGPQFGQYDYWGQGTLVTVSS

SEQ ID NO: 10079 - protein, 120 aa, Artificial Sequence
  Description of Artificial Sequence: Synthetic polypeptide
EVQLLESGGGLVQPGGSLRLSCSASGFTFSGYDMQWVRQAPGKGLEWVSTISASGVYTYYADSVKGRFTISRDNSKNTLYLQMNSLRAEDTAVYYCAKYPNFALNSFDYRGRGTLVTVSS

SEQ ID NO: 10080 - protein, 116 aa, Artificial Sequence
  Description of Artificial Sequence: Synthetic polypeptide
EVQLLESGGGLVQPGGSLRLSCAASGFTFRDYEMWWVRQAPGKGLERVSAINPWGGFTYYADSVKGRFTISRDNSKNTLYLQMNSLRAEDTAVYYCAKLPFFFHEWGQGTLVTVSS

SEQ ID NO: 10081 - protein, 118 aa, Artificial Sequence
  Description of Artificial Sequence: Synthetic polypeptide
EVQLLESGGGLVQPGGSLRLSCAASGFTFADEPMTWVRQAPGGLEWVSRIPPEGAPTYYADSVKGRFTISRDNSKNTLYLQMNSLRAEDTAVYYCAKGITPNLTFDYWGQGTLVTVSS

SEQ ID NO: 10082 - protein, 120 aa, Artificial Sequence
  Description of Artificial Sequence: Synthetic polypeptide
EVQLLESGGGLVQPGGSLRLSCAASGFTFSGYDMQVRQAPGRGLEWVSTISASGVYTYYTDSVKGRFTTSRDNSKNTLYLQMNSLRAEDTAVYYCTKYPNRFARNNFDYWGQGTLVTVSS

SEQ ID NO: 10083 - protein, 107 aa, Artificial Sequence
  Description of Artificial Sequence: Synthetic polypeptide
DILMTQSPSSLSASVGDRVTITCRANSSILWALAYQQKPGEAPKLLIESSSGLQSGVPSRFSGSGSGTDFTLTISSLQPEDFATYYCVQNAVWPGTFSQGTKVEIKR

SEQ ID NO: 10084 - protein, 108 aa, Artificial Sequence
  Description of Artificial Sequence: Synthetic polypeptide
DIQMTQSPSSLSASVGDRVTITCRADSSILWALAWYQQKPGKAPKLLIESSSGLQSGVPSRFSGSGSGTDFTLTISSLQPEDFATYYCVQNAVWPGTFGQGTKVEIKR

SEQ ID NO: 10085 - protein, 106 aa, Artificial Sequence
  Description of Artificial Sequence: Synthetic polypeptide
DIQMTVSPSSLSASVGDRVTITCRADSSILWALAYQQKPGAPKLLIESSSGLQSGVPSRFSGSGSGTDFTLTISSLQPEDFATYYCVQNAVWPGTFGQGTKVEIKR

SEQ ID NO: 10086 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAVWPGTFDQGTKVEIKR

SEQ ID NO: 10087 - protein, 108 aa, Artificial Sequence
  Description of Artificial Sequence: Synthetic polypeptide
DIQMTQSPSSLSASVGDRVTITCRANSSILWALAWYQQKPGKAPKLLIESSTGLQSGVPSRFSGSGSGTDFTLTISSLQPEDFATYYCVQNAVWPGTFGQGTKVEIKR

SEQ ID NO: 10088 - protein, 107 aa, Artificial Sequence
  Description of Artificial Sequence: Synthetic polypeptide
DIQIWSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVEIKR

SEQ ID NO: 10089 - protein, 107 aa, Artificial Sequence
  Description of Artificial Sequence: Synthetic polypeptide
DIQMTQSPSSLSASVGDRVTITCRADSSILWALAWYQQKPGKAPKLLIESSSGLQSGVPSRFSGSGSGTDFTLTISSLQPEDFATYYCVQNAVWPGTFDQGTKVEIR

SEQ ID NO: 10090 - protein, 108 aa, Artificial Sequence
  Description of Artificial Sequence: Synthetic polypeptide
DIQMTQSPSSLSASVGDRVTITCRANSSILWALAWYQQKPGKAPELLIESSSGLQSGVPSRFSGSGSGTDFTLTISSLQPEDFATYYCVQNAVWPGTFGQGTKVEIKR

SEQ ID NO: 10091 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVENKR

SEQ ID NO: 10092 - protein, 116 aa, Artificial Sequence
  Description of Artificial Sequence: Synthetic polypeptide
EVQLLESGGGLVQPGGSLRLSCAASGFTFHNHDMSWVRQAPGGLEWVSRISRGGLQTYYADSVKGRFTISRDNSNTLYLQMNSLRAEDTAVYYCAGIVPDLHFDYWGQGTLVTVSS

SEQ ID NO: 10093 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVEIKR

SEQ ID NO: 10094 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGIPSRFSGSGSGTDFTLTISSLQPEDFATYYCVQNAVWPGTFGQGTKVEIKR

SEQ ID NO: 10095 - protein, 108 aa, Artificial Sequence; identical to SEQ ID NO: 10093
  Description of Artificial Sequence: Synthetic polypeptide

SEQ ID NO: 10096 - protein, 108 aa, Artificial Sequence
  Description of Artificial Sequence: Synthetic polypeptide
DILLTQSPSSLSASVGDRVTITCRANSSILWALAWYQQKPGKAPKLLIESSSGLQSGVPSRFSGSGSGTDFTLTISSLQPEDFATYYCVQNAVWPGTFGQGTKVEIKR

SEQ ID NO: 10097 - protein, 108 aa, Artificial Sequence
  Description of Artificial Sequence: Synthetic polypeptide
DIQMTQSPSSLSASVGDRVTITCRANSSILWALAWYQQKPGKAPKLLIESSSGLQSGVPSRFSGSGTGTDFTLTISGLQPEDFATYYCVQNAVWPGTFDQGTKVEIKR

SEQ ID NO: 10098 - protein, 108 aa, Artificial Sequence
  Description of Artificial Sequence: Synthetic polypeptide
DIQMTQSPSSLSASVGDRVTIPCRANSSILWALAWYQQKPGKAPKLLIESSSGLQSGVPSRFSGSASGTDFTLTISSLQPEDFATYYCVQNAVWPGTFGQGTKVEIKR

SEQ ID NO: 10099 - protein, 108 aa, Artificial Sequence
  Description of Artificial Sequence: Synthetic polypeptide
DIQMAQSPSSLSASVGDRVTITCRASQTIERRLNWYQQKPGKAPKLLIYLASRLQSGVPSRFSGSGSGTDFTLTISSLQPEDFATYYCHQYASPPLTLGQGTKVEIKR

SEQ ID NO: 10100 - protein, 108 aa, Artificial Sequence
  Description of Artificial Sequence: Synthetic polypeptide
DIQMTQSPSSLSASVGDSVTITCRASQTIERRLNWYQQKPGEAPKLLIYLASRLQSGVPSRFSGSGSGTDFTLTISSLQPEDFATYYCHQYASPPLTFGQGTNVEIKR

SEQ ID NO: 10101 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFAAYYCHQYESPPLTFGQGTKVEIKR

SEQ ID NO: 10102 - protein, 106 aa, Artificial Sequence
  Description of Artificial Sequence: Synthetic polypeptide
DIQMTQSPSSLSASVGDRVTITCRASRTIERRLNWYQQKPGKAPKLLIYLASRLQSGVPSRFSGSGSGTDFTLTISSLQPEDFATYYCHQYESPPLTFGQGTVEIR

SEQ ID NO: 10103 - protein, 119 aa, Artificial Sequence
  Description of Artificial Sequence: Synthetic polypeptide
EVQLLESGGGLVQPGGSLRLSCAASGFTFNEYPMSWVRQAPGKGLEWVSRINGDGANTYYADSVKGRFTISRDNSKNTLYLQMNSLRAEDTAVYYCAKGIIPAMQFDYWGQGTLVTVSS

SEQ ID NO: 10104 - protein, 107 aa, Artificial Sequence
  Description of Artificial Sequence: Synthetic polypeptide
DIQMTQSPSSLSASVGERVTITCRASQTIERRLNWYQQKPGKAPKLLIYLASRLQSGVPSRFSGSGSGTDFTLTISNLQPEDSATYYCHQYASPPLTLGQGTKVEIR

SEQ ID NO: 10105 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYASPPLTLGQGTKVEIKR

SEQ ID NO: 10106 - protein, 107 aa, Artificial Sequence
  Description of Artificial Sequence: Synthetic polypeptide
DIQITQSPSSLSASVGDRVTITCRASQTIERRLNWYQQPGKDPKLLIYLASRLQSGVPSRFSGSGSGTDFTLTISSLQPEDFATYYCHQYESPPLTFGQGTKVEIKR

SEQ ID NO: 10107 - protein, 108 aa, Artificial Sequence
  Description of Artificial Sequence: Synthetic polypeptide
DIQMTQSPSSLSASVGDRVTITCRASQTIERRLNWYQQKPGEAPKLLIYLASRLQSGVPSRFSGSGSGTDFTLTISSLQPEDFATYYCHQYESPPLTFGQGTKVEIKW

SEQ ID NO: 10108 - protein, 108 aa, Artificial Sequence
  Description of Artificial Sequence: Synthetic polypeptide
DIQLTQSPSSLSASVGDRVTITCRASQTIERRLNWYQQKPGKAPKLLIYLASRLQSGVPSRFSGSGSGTEFTLTISSLQPEDFATYYCHQYESPPLTFGQGTKVEIKR

SEQ ID NO: 10109 - protein, 108 aa, Artificial Sequence
  Description of Artificial Sequence: Synthetic polypeptide
DIQMSQSPSTLSASVGDRVTITCRASQTIERRLNWYQQKPGKAPKLLIYLASRLQSGVPSRFSGSGSGTDFTLTISSLQPEDFATYYCHQYESPPLMFGQGTKVEIKR

SEQ ID NO: 10110 - protein, 108 aa, Artificial Sequence
  Description of Artificial Sequence: Synthetic polypeptide
DIQMTQSPSSLSASVGDRVTITCRASQTIERRLNWYQQKPGKDPKLLIYLASRLQSGVPSRFSGSGSGTDFTLTISSLQPEDFATYYCHQYESPPLTFGQGTKVEIKR

SEQ ID NO: 10111 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 10112 - protein, 108 aa, Artificial Sequence
  Description of Artificial Sequence: Synthetic polypeptide
DIQMTQSPSSLFASVGDRVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 10113 - protein, 107 aa, Artificial Sequence
  Description of Artificial Sequence: Synthetic polypeptide
DIQMTQYPSSLSASVGDRVTITCRASQSIERRLNYQQKPGEAPKLLIYLASRLQSGVPSRFSGSGSGTDFTLTISSLQPEDFATYYCHQYESPPLTFGQGTKVEIKR

SEQ ID NO: 10114 - protein, 119 aa, Artificial Sequence
  Description of Artificial Sequence: Synthetic polypeptide
EVQLLESGGGLVQPGGSLRLSCAASGFTFGDVPMSWVRQAPGKGLEWVSRIDPYGSNTYYADSVKGRFTISRDNSKNTLYLQMNSLRAEDTAVYYCAKGIMPSLTFDYWGQGTLVTVSS

SEQ ID NO: 10115 - protein, 108 aa, Artificial Sequence
  Description of Artificial Sequence: Synthetic polypeptide
DIQMTQSPSSLSASVGDRVTITCRASRTIERRLNWYQQKPGKAPKLLIYLASRLQSGVPSRFSGSGSGTDFTLTISSLQPEDFATYYCHPYESPPLTFGQGTKVEIKR

SEQ ID NO: 10116 - protein, 106 aa, Artificial Sequence
  Description of Artificial Sequence: Synthetic polypeptide
DIQMTQSPSSLSASVGDRVTITCRASQAIERRLNWYQQKPGKAPKLLIYLASRLQSGVPSRFSGSGSGTDFTLTISSLQPEDFATYYCHQYASPPLTLGQGTVEIR

SEQ ID NO: 10117 - protein, 106 aa, Artificial Sequence
  Description of Artificial Sequence: Synthetic polypeptide
NIQMTQSPSSLSASVGDRVTITCRASQAIERRLNYQQKPGKAPLLIYLASRLQSGVPSRFSGSGSGTDFTLTISSLQPEDFATYYCHQYESPPLTFGQGTKVEIKR

SEQ ID NO: 10118 - protein, 108 aa, Artificial Sequence
  Description of Artificial Sequence: Synthetic polypeptide
DIQMTQSPSSLSASVGDRVTITCRASQTIGRRLNWYQQKPGKAPKLLIYLASRLQSGVPSRFSGSGSGSDFTLTISSLQPEDFATYYCHQYESPPLTFGQGTKVEIKR

SEQ ID NO: 10119 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTEFTLTISSLQPEDFATYYCHQYESPPLTFGQGTKVEIKR

SEQ ID NO: 10120 - protein, 107 aa, Artificial Sequence
  Description of Artificial Sequence: Synthetic polypeptide
DIQMTQTPSSLSASVGDRVTITCRASQTIERLNWYQQKPGEAPKLLIYLASRLQSGVPSRFSGSGSGTDFTLTISSLQPEDFATYYCHQYESPPLTFGQGTKVKIKR

SEQ ID NO: 10121 - protein, 108 aa, Artificial Sequence
  Description of Artificial Sequence: Synthetic polypeptide
DIQMTQSPSSLSASVGDSVTITCRASQTIERRLNWYQQKPGKAPKLLIYLASRLQSGVPSRFSGSGSGTDFTLTISSLQPEDFATYYCHQYESPPLTFGQGTKVEIKR

SEQ ID NO: 10122 - protein, 107 aa, Artificial Sequence
  Description of Artificial Sequence: Synthetic polypeptide
HIQMTQSPSSLSASVGDRVTITCRASQTIERRLNYQQKPGKAPKLLIYLASRLQSGVPSRFSGSGSGTDFTLTISSLQPEDFATYYCHQYESPPLTFGQGTKVEIKR

SEQ ID NO: 10123 - protein, 108 aa, Artificial Sequence
  Description of Artificial Sequence: Synthetic polypeptide
DVQMTQSPSSLSASVGDRVTITCRASQTIERRLNWYQQKPGEAPKLLIYLTSRLQSGVPSRFSGSGSGTDFTLTISSLQPEDFATYYCHQYASPPLTFGQGTKVEIKR

SEQ ID NO: 10124 - protein, 107 aa, Artificial Sequence
  Description of Artificial Sequence: Synthetic polypeptide
DIQMTQSPSSLSASVGDRVTITCRASQTIERRLNWYQQKPGKAPKLLIYLASRLQSGVPSRFSGSGSGTDFTLTISSLQPEDFATYYCHQYESPPLTFGQGTKWIKR

SEQ ID NO: 10125 - protein, 119 aa, Artificial Sequence
  Description of Artificial Sequence: Synthetic polypeptide
EVQLLESGGGLVQPGGSLRLSCAASGFTFADYDMSWVRQAPGKGLEWVSRISALGATTYYADSVKGRFTISRDNSKNTLYLQMNSLRAEDTAVYYCAKGQLPALEFDYWGQGTLVTVSS

SEQ ID NO: 10126 - protein, 108 aa, Artificial Sequence
  Description of Artificial Sequence: Synthetic polypeptide
DIQMTQSPSSLSASVGDRVTITCRASQTIERRLNWYQQKPGKAPRLLIYLATRLQSGVPSRFSGSGSGTDFTLTISSLQPEDFATYYCHQYESPPLTFGQGTKVEIKR

SEQ ID NO: 10127 - protein, 108 aa, Artificial Sequence
  Description of Artificial Sequence: Synthetic polypeptide
DIQMTQSPSSLSASVGDRVTITCRASQPIERRLNWYQQKPGKAPKLLIYLASRLQSGVPSRFSGSGSGTDFTLTISSLQPEDFATYYCHQYESPPLTFGQGTKVEIKR

SEQ ID NO: 10128 - protein, 107 aa, Artificial Sequence
  Description of Artificial Sequence: Synthetic polypeptide
DIQMTQSPSSLSASVGDRVTITCRASQTIGRRLNWYQQKPGKAPKLLIYLASRLQSGVPSRFSGSGSGTDFTLTISSLQPEDFATYYCHQYESPPLTFGQGTVEIKR

SEQ ID NO: 10129 - protein, 108 aa, Artificial Sequence
  Description of Artificial Sequence: Synthetic polypeptide
DIQMTQSPSSLSASVGDRVTITCRASQSIERRLNWYQQKPGKAPKLLIYLASRLQSGVPSRFSGSGSGTDFTLTISSLQPEDFATYYCHQYESPPLTFGQGTKVEIIR

SEQ ID NO: 10130 - protein, 108 aa, Artificial Sequence
  Description of Artificial Sequence: Synthetic polypeptide
DIQMTQSPSSLSASVGDRVTITCRASQTIERRLNWYQQKPGKAPKLLIYLATRLQSGVPSRFSGSGSGTDFTLTISSLQPEDFATYYCHQYESPPLTFGQGTKVEIKR

SEQ ID NO: 10131 - protein, 108 aa, Artificial Sequence
  Description of Artificial Sequence: Synthetic polypeptide
DIQMTQSPSSLSASVGDRVTITCRASQSIERRLNWYQQKPGKAPKLLIYLASRLQSGVPSRFSGSGSGTDFTLTISSLQPEDFATYYCHQYESPPLTFGQGTKVEIKR

SEQ ID NO: 10132 - protein, 108 aa, Artificial Sequence
  Description of Artificial Sequence: Synthetic polypeptide
DIQMTQSPSSLSASVGDRVTITCRASQTIERRLNWYQQKPGKAPRLLIYLATRLQSGVPSRFSGSGSGTDFTLTISSLQPEDFATYYCHQFEHPPLTFGQGTKVEIKR

SEQ ID NO: 10133 - protein, 108 aa, Artificial Sequence
  Description of Artificial Sequence: Synthetic polypeptide
DIQMTQSPSSLSASVGDRVTITCRASFPIDRRLNWYQQKPGKAPRLLIYLATRLQSGVPSRFSGSGSGTDFTLTISSLQPEDFATYYCHQYESPPLTFGQGTKVEIKR

SEQ ID NO: 10134 - protein, 108 aa, Artificial Sequence
  Description of Artificial Sequence: Synthetic polypeptide
DIQMTQSPSSLSASVGDRVTITCRASSTIGRRLNWYQQKPGKAPRLLIYLATRLQSGVPSRFSGSGSGTDFTLTISSLQPEDFATYYCHQYESPPLTFGQGTKVEIKR

SEQ ID NO: 10135 - protein, 108 aa, Artificial Sequence
  Description of Artificial Sequence: Synthetic polypeptide
DIQMTQSPSSLSASVGDRVTITCRASSQIGRRLNWYQQKPGKAPRLLIYLATRLQSGVPSRFSGSGSGTDFTLTISSLQPEDFATYYCHQYESPPLTFGQGTKVEIKR

SEQ ID NO: 10136 - protein, 117 aa, Artificial Sequence
  Description of Artificial Sequence: Synthetic polypeptide
EVQLLESGGGLVQPGGSLRLSCAASGFTFKRYYMTWVRQAPGKDLEWVSGIVPSGNRTYYADSVKGRFTISRDNSKNTLYLQMNSLRAEDTAVYYCAGRIPDLHFDYGQGTLVTVSS

SEQ ID NO: 10137 - protein, 108 aa, Artificial Sequence
  Description of Artificial Sequence: Synthetic polypeptide
DIQMTQSPSSLSASVGDRVTITCRASERIGRRLNWYQQKPGKAPRLLIYLATRLQSGVPSRFSGSGSGTDFTLTISSLQPEDFATYYCHQYESPPLTFGQGTKVEIKR

SEQ ID NO: 10138 - protein, 107 aa, Artificial Sequence
  Description of Artificial Sequence: Synthetic polypeptide
DIQMTQSPSSLSASVGDRVTITCRASQQIGRRLNYQQKPGKAPRLLIYLATRLQSGVPSRFSGSGSGTDFTLTISSLQPEDFATYYCHQYESPPLTFGQGTKVEIKR

SEQ ID NO: 10139 - protein, 108 aa, Artificial Sequence
  Description of Artificial Sequence: Synthetic polypeptide
DIQMTQSPSSLSASVGDRVTITCRASQPIARRLNWYQQKPGKAPRLLIYLATRLQSGVPSRFSGSGSGTDFTLTISSLQPEDFATYYCHQYESPPLTFGQGTKVEIKR

SEQ ID NO: 10140 - protein, 107 aa, Artificial Sequence
  Description of Artificial Sequence: Synthetic polypeptide
DIQMTQSPSSLSASVGDRVTITCRASGNIGRRLNYQQKPGKAPRLLIYLATRLQSGVPSRFSGSGSGTDFTLTISSLQPEDFATYYCHQYESPPLTFGQGTKVEIKR

SEQ ID NO: 10141 - protein, 108 aa, Artificial Sequence
  Description of Artificial Sequence: Synthetic polypeptide
DIQMTQSPSSLSASVGDRVTITCRASRNIDRRLNWYQQKPGKAPRLLIYLATRLQSGVPSRFSGSGSGTDFTLTISSLQPEDFATYYCHQYESPPLTFGQGTKVEIKR

SEQ ID NO: 10142 - protein, 106 aa, Artificial Sequence
  Description of Artificial Sequence: Synthetic polypeptide
DIQMTQSPSSLSASVGDRVTITCRASQNIGTRLNWYQQPGAPRLLIYLATRLQSGVPSRFSGSGSGTDFTLTISSLQPEDFATYYCHQYESPPLTFGQGTKVEIKR

SEQ ID NO: 10143 - protein, 108 aa, Artificial Sequence
  Description of Artificial Sequence: Synthetic polypeptide
DIQMTQSPSSLSASVGDRVTITCRASEVIGRRLNWYQQKPGKAPRLLIYLATRLQSGVPSRFSGSGSGTDFTLTISSLQPEDFATYYCHQYESPPLTFGQGTKVEIKR

SEQ ID NO: 10144 - protein, 108 aa, Artificial Sequence
  Description of Artificial Sequence: Synthetic polypeptide
DIQMTQSPSSLSASVGDRVTITCRASEAIGRRLNWYQQKPGKAPRLLIYLATRLQSGVPSRFSGSGSGTDFTLTISSLQPEDFATYYCHQYESPPLTFGQGTKVEIKR

SEQ ID NO: 10145 - protein, 108 aa, Artificial Sequence
  Description of Artificial Sequence: Synthetic polypeptide
DIQMTQSPSSLSASVGDRVTITCRASTSIARRLNWYQQKPGKAPRLLIYLATRLQSGVPSRFSGSGSGTDFTLTISSLQPEDFATYYCHQYESPPLTFGQGTKVEIKR

SEQ ID NO: 10146 - protein, 122 aa, Artificial Sequence
  Description of Artificial Sequence: Synthetic polypeptide
EVQLLESGGGLVQPGGSLRLSCAASGFTFADYDMTWVRQAPGKGLEWVSRISPTGGQTYYADSVKGRFTISRDNSKNTLYLQMNSLRAEDTAVYYCAKGVIPYLSFSPFDYWGQGTLVTVSS

SEQ ID NO: 10147 - protein, 108 aa, Artificial Sequence
  Description of Artificial Sequence: Synthetic polypeptide
DIQMTQSPSSLSASVGDRVTITCRASQTIERRLNWYQQKPGKAPRLLIYLSSKLQSGVPSRFSGSGSGTDFTLTISSLQPEDFATYYCHQYESPPLTFGQGTKVEIKR

SEQ ID NO: 10148 - protein, 116 aa, Artificial Sequence
  Description of Artificial Sequence: Synthetic polypeptide
EVQPLESGGGLVQPGGSLRLSCAASGFTFAGYEMWWVRQAPGKGLERISAISGSGGSTYYADSVKGRFTISRDDSKNTLYLQMNSLRAEDTAVYYCARDPYSFDYWGQGTLVTVSS

SEQ ID NO: 10149 - protein, 116 aa, Artificial Sequence
  Description of Artificial Sequence: Synthetic polypeptide
EVQLLESGGGSVQPGGSLRLSCAATGSTFAGYEMWWVRQAPGKGLERVSAISGSGGSTYYADSVKGRFTISRDDSKNTLYLQMNSLRAEDTAVYYCARDPYSYDYWGQGTLVSVSS

SEQ ID NO: 10150 - protein, 116 aa, Artificial Sequence
  Description of Artificial Sequence: Synthetic polypeptide
EVQLLESGGGLVQPGGSLRLSCAASGLTFAGYEMWWVRQAPGKGLERVSAISGSGGSTYYADSVKGRFTISRDDSKNTLYLQMNSLRAEDTAVYHCARDPYSFDYWGQGTLVTVSS

SEQ ID NO: 10151 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYHCAKEPYSYDYWGQGTLVTVSS

SEQ ID NO: 10152 - protein, 116 aa, Artificial Sequence
  Description of Artificial Sequence: Synthetic polypeptide
EVQLLESGGGLVQPGGSLRLSCAASGSTFAGYEMWWVRQAPGKGLERVSAISGSGGSTYYADSVKGRFTISRDDSKNTLYLQMNSLRPEDTAVYYCVKDPYSFDYWGQGTLVTVSS

SEQ ID NO: 10153 - protein, 116 aa, Artificial Sequence
  Description of Artificial Sequence: Synthetic polypeptide
EVQLLESGGGLVQPGGSLRLSCAASGSTIAGYEMWWVRQAPGKGLERVSAISGSGGSTYYADSVKGRFTISRDDSKNTLYLQMNSLRAEDTAVYYCARDPYSFDYWGQGTPVTVSS

SEQ ID NO: 10154 - protein, 116 aa, Artificial Sequence
  Description of Artificial Sequence: Synthetic polypeptide
EVQLMESGGGLVQPGGSLRLSCAASGSTFAGYEMWWYRQAPGKGLERVSAISGSGRSTYYADSVKGRFTISRDDSKNTLYLQMNSLRAEDTAVYYCAKDPYSFDYWGQGTLVTVSS

SEQ ID NO: 10155 - protein, 108 aa, Artificial Sequence
  Description of Artificial Sequence: Synthetic polypeptide
DIQMTQSPSSLSASVGDRVTITCRASLNIGRRLNWYQQKPGKAPRLLIYLATRLQSGVPSRFSGSGSGTDFTLTISSLQPEDFATYYCHQYESPPLTFGQGTKVEIKR

SEQ ID NO: 10156 - protein, 119 aa, Artificial Sequence
  Description of Artificial Sequence: Synthetic polypeptide
EVQLLESGGGLVQPGGSLRLSCAASGFTFSKYWMGWARQAPGGLEWVSSIDSHGAGTYYADSVKGRFTISRDNSNTLYLQMNSLRVEDTAVYYCAKGAPKFMTTYTFDYGQGTLVTVSS

SEQ ID NO: 10157 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKEPYSFDYWGQGTLVTVSS

SEQ ID NO: 10158 - protein, 116 aa, Artificial Sequence
  Description of Artificial Sequence: Synthetic polypeptide
EVQLLESGGGLVQPGGSLRLSCAASGSTIAGYEMWWVRQAPGKGLERVSAISGSGGSTYYADSVKGRFTISRDDSKNTLYLQMNSLRAEDTAVYYCAKDPYSFDYWGQGTLVTVSS

SEQ ID NO: 10159 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCARDPYSFDYWGQGTLVSVSS

SEQ ID NO: 10160 - protein, 116 aa, Artificial Sequence
  Description of Artificial Sequence: Synthetic polypeptide
EVQLLESGGGLVQPGGSLRLSCAASGFTIAGYEMWWVRQAPGKGLERVSAISGSGGSTYYADSVKGRFTISRDDSKNTLYLQMNSLRAEDTAVYYCAKDPYSFDYWGQGTLVTVSS

SEQ ID NO: 10161 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTITRDDSKNTLYLQMNSLRAEDTAVYYCAKEPYSFDYWGQGTLVTVSS

SEQ ID NO: 10162 - protein, 115 aa, Artificial Sequence
  Description of Artificial Sequence: Synthetic polypeptide
EVQLLESGGGLVQPGGSLRLSCAASGFTFAGYEMWWFRQAPGKGLERVSAISGSGGSTYYADSVKGRFTISRDDTNTLYLQMNSLRAEDTAVYYCAKDPYSFDYWRQGTLVTVSS

SEQ ID NO: 10163 - protein, 115 aa, Artificial Sequence
  Description of Artificial Sequence: Synthetic polypeptide
EVQLLESGGGLVQPGGSLRLSCAASGSTFAGYEVWWVRQAPGGLERVSAISGSGGSTYYADSVKGRFTISRDDSKNTLYLQMNSLRAEDTAVYYCARDPYSFDYWGQGTLVTVSS

SEQ ID NO: 10164 - protein, 114 aa, Artificial Sequence
  Description of Artificial Sequence: Synthetic polypeptide
EVQLLESGGGLVQPGGSLRLSCAASGSTFAGYEMWWVRQAPGKGLERISAISGSGGSTYYADSVGRFTISRDDSKNTLYLMNSLRAEDTAVYYCAKDPYSFDYWGQGTLVTVSS

SEQ ID NO: 10165 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCARDPYSFDYWGQGTLVTVSS

SEQ ID NO: 10166 - protein, 116 aa, Artificial Sequence
  Description of Artificial Sequence: Synthetic polypeptide
EVQLLESGGGLVQPGGSLRLSCAASGLTFAGYEMWWVRRAPGKGLERVAAISGSGGSTYYADSVKGRFTISRDDSKNTLYLQMNSLRAEDTAVYYCARDPYSFDYWGQGTLVTVSS

SEQ ID NO: 10167 - protein, 117 aa, Artificial Sequence
  Description of Artificial Sequence: Synthetic polypeptide
EVQLLESGGGLVQPGGSLRLSCAASGFTFLSYPMHWVRQAPGKGLEWVSSIDSRGSVTYYADSVKGRFTISRDNSKNTLYLQMNSLRAEDTAVYYCAKGHSWTFDYWGQGTLVTVSS

SEQ ID NO: 10168 - protein, 116 aa, Artificial Sequence
  Description of Artificial Sequence: Synthetic polypeptide
EVQLLESGGGLVQPGGSLRLSCAASGFTFAGYELWWVRQAPGKGLERVSAISGSGGSTYYADSVKGRFTISRDDSKNTLYLQMNSLRAEDTAVYYCARDPYSFDYRGQGTLVTVSS

SEQ ID NO: 10169 - protein, 115 aa, Artificial Sequence
  Description of Artificial Sequence: Synthetic polypeptide
EVQLLESGGGLVQPGGSLRLSCAAPGFTLAGYEMWWVRQAPGKGLERVSAISGSGGSTYYADSVKGRFTISRDDSKNTLYLQMNSLRAEDTAVYYCAEPYSFDYWGQGTLVTVSS

SEQ ID NO: 10170 - protein, 116 aa, Artificial Sequence
  Description of Artificial Sequence: Synthetic polypeptide
EVQLLESGGGLVQPGGSLRLSCAASGLTFAGYEMWWVRRAPGKGLERVSAISGSGGSTYYADSVKGRFTTSRDDSKNTLYLQMNSLRAEDTAVYYCARDPYSFDYWGRGTLVTVSS

SEQ ID NO: 10171 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKEPYSYDYWGHGTLVTVSS

SEQ ID NO: 10172 - protein, 113 aa, Artificial Sequence
  Description of Artificial Sequence: Synthetic polypeptide
EVQPLESGGGLVQPGGSLRLSCAASGFTFAGYEMWWVRQAPGKGLERVSAISGSGGNTYYADSVKGRFTISRDDSKNTLYLQMNSLRAEDTGYYCADPYSFDYGQGTLVTVSS

SEQ ID NO: 10173 - protein, 114 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAEPYSFDSGQGTLVTVSS

SEQ ID NO: 10174 - protein, 113 aa, Artificial Sequence
  Description of Artificial Sequence: Synthetic polypeptide
EAQLLESGGGLVQPGGSLLSCAASGLTFAGYEMWWVRQAPGKGLERVSAISGSGGSTYYADSVKGRFTISRDDSKNTLYLQMNSLRAEDTAYYCARDPYSFDYWGQGTLTVSS

SEQ ID NO: 10175 - protein, 115 aa, Artificial Sequence
  Description of Artificial Sequence: Synthetic polypeptide
EVQLLESGGGLVQPGGSLRLSCAASGSTFAGYEMWWVRQAPGKGLERVSAISGSGGSTYYADSVKGRFSISRDDSKNTLYLQMNSLRAEDTAVYYCAKEPYSFDHWGQGTLTVSS

SEQ ID NO: 10176 - protein, 115 aa, Artificial Sequence
  Description of Artificial Sequence: Synthetic polypeptide
EVQLLESGGGLVQPGGSLRLSCAASGSTFAGYEMWWVRRAPGGLERVSAISGSGGSTYYADSVKGRFTISRDDSKNTLYLQMNSLRAEDTAVYYCARDPYSFDYWGQGTLVTVSS

SEQ ID NO: 10177 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAISGSGGSTYYADSVKGRFTISRDDSKNTLYLQMNSLRAEDTAVYYCAKDPYSFDNWGQGTLVTVSS

SEQ ID NO: 10178 - protein, 113 aa, Artificial Sequence
  Description of Artificial Sequence: Synthetic polypeptide
EVQLLESGGGLVQPGGSLRLSCAASGFTFAGYEMWWVRQAPGGLERVSAISGSGGSTYYADSVGRFTISRDDSKNTLYLQMMSLRAEDTAVYYCAKEPYSYDYGQGTLVTVSS

SEQ ID NO: 10179 - protein, 116 aa, Artificial Sequence
  Description of Artificial Sequence: Synthetic polypeptide
EVQLLESGGGLVEPGGSLRLSCAASGFTFAGYEMWWVRQAPGKGLERVSAISGSGGSTYYADSVKGRFTISRDDSKNTLYLQMNSLRAEDTAVYYCAKEPYSFDHRGQGTLVTVSS

SEQ ID NO: 10180 - protein, 116 aa, Artificial Sequence
  Description of Artificial Sequence: Synthetic polypeptide
EVQLLESGGGLVQPGGSLRLSCAASGYTFAGYEMWWVRQAPGKGLERVSAISGSGGSTYYADSVKGRFTISRDDSKNTLYLQMNSLRAEDTAVYYCAKEPYSFDHRGQGTLVTVSS

SEQ ID NO: 10181 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDNSKNTLYLQMNSLRAEDTAVYHCAKEPYSYDYWGQGTLVTVSS

SEQ ID NO: 10182 - protein, 116 aa, Artificial Sequence
  Description of Artificial Sequence: Synthetic polypeptide
EVQLLESGGGLVQPGGSLRLSCAASGFTFAGYEMWWFRQAPGKGLERVSAISGSGGSTYYADSVKGRFTISRDNSKNTLYLQMNSLRAEDTAVYYCAKDPYSFDNWGQGTLVTVSS

SEQ ID NO: 10183 - protein, 116 aa, Artificial Sequence
  Description of Artificial Sequence: Synthetic polypeptide
EVQLLESGGGLVQPGGSLRLSCAASGFTFAGYEMWWVRQAPGKGLERVSAISGSGGSTYYADSVKGRFTISRDDSKNTLYLQMNSLRAEDTAVYYCAKDPYSFDNWGQGTLVTVSS

SEQ ID NO: 10184 - protein, 115 aa, Artificial Sequence
  Description of Artificial Sequence: Synthetic polypeptide
EVQLLESGGGLVQPGGSLRLSCAASGFTFAGYEMWVRQAPGKGLEWVSAISGSGGSTYYADSVKGRFTISRDDSKNTLYLQMNSLRAEDTAVYHCAKEPYSYDYWGQGTLVTVSS

SEQ ID NO: 10185 - protein, 114 aa, Artificial Sequence
  Description of Artificial Sequence: Synthetic polypeptide
EVQLLESGGGLVQPGGSLRLSCAASGFTFAGYEMWWFRQAPGGLEWVSAISGSGGSTYYADSVKGRFTISRDDSNTLYLQMNSLRAEDTAVYYCAKDPYSFDNWGQGTLVTVSS

SEQ ID NO: 10186 - protein, 115 aa, Artificial Sequence
  Description of Artificial Sequence: Synthetic polypeptide
EVQLLESGGGLVQPGGSLRLSCAASGFTFAGYELWWVRQAPGKGLERVSAISGSGGSTYYADSVKGRFTISRDDSNTLYLQMNSLRAEDTAVYYCAKDPYSFDYRGQGTLVTVSS

SEQ ID NO: 10187 - protein, 114 aa, Artificial Sequence
  Description of Artificial Sequence: Synthetic polypeptide
EVQLLESGGGLVQPGGSLRLSCAASGFTFAGYELWWRQAPGKGLERVSAISGSGGSTWADSVKGRFTISRDDSKNTLYLQMNSLRAEDTAVYYCARDPYSFDYWGQGTLVTVSS

SEQ ID NO: 10188 - protein, 117 aa, Artificial Sequence
  Description of Artificial Sequence: Synthetic polypeptide
EVQLLESGGGLVQPGGSLRLSCAASGFTFGPRRMGWVRQAPGGLEWVSSIDDIGRRTYYADSVGRFTISRDNSKNTLYLQMNSLRAEDTAVYYCAEGAQGVLLFDYWGQGTLVTVSS

SEQ ID NO: 10189 - protein, 115 aa, Artificial Sequence
  Description of Artificial Sequence: Synthetic polypeptide
EVQLLESGGGLVQPGGSLRLSCAASGFTFPTAEMLVRKAPGKGLEWVSSISASGGSTYYADSVKGRFTISRDNSNTLYLQMNSLRAEDTAVYYCAKEPSYVATFDYGQGTLVTSS

SEQ ID NO: 10190 - protein, 118 aa, Artificial Sequence
  Description of Artificial Sequence: Synthetic polypeptide
EVQLLVSGGGLVQPGGSLRLSCAASGFTFPTAEMLWVRQAPGGPEWVSSISASGGSTYYADSVKGRFTISRDNSNTLYLQMNSLRAEDTAVYYCAKEPVSYVATFDYWGQGTLVTVSS

SEQ ID NO: 10191 - protein, 116 aa, Artificial Sequence
  Description of Artificial Sequence: Synthetic polypeptide
EVQLLESGGGLVQPGGSLRLSCAASGFTFPTAEMVVRAPGMGLEWVSSISASGGYTYYADSVKGRFTISRDNSNMLYLQMNSLRAEDTAVYYCAKEPVSYVATFDYGQGALVTVTS

SEQ ID NO: 10192 - protein, 117 aa, Artificial Sequence
  Description of Artificial Sequence: Synthetic polypeptide
EVQLLVSGGGLVQPGGSLRLSCAASGFTFPTAEMVVRQAPGKGLEWVSSISASGGSTYYADSVKGRFSISRDDSKNTLYLQMNSLRAEDTAVYYCAKEPVSYVATFDYGHGALVTSS

SEQ ID NO: 10193 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKNTLYLQMNSLRAEDTAVYYCAKEPVSYVATFDYWGQGTLVTVSS

SEQ ID NO: 10194 - protein, 117 aa, Artificial Sequence
  Description of Artificial Sequence: Synthetic polypeptide
EAQLLESGGGLVQPGGSLRLSCAASGFTFPTAEMVWVRQAPGKGLEWISSISASGGSTYYADSVGRFTISRDNSNTLYLQLNSLRAEDTAVYYCAKEVSYVATFDYWGRGTLVTVSS

SEQ ID NO: 10195 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKSTLYLQMNSLRAEDTAVYYCAKEPVSYVATFDYWGPGALVTVSS

SEQ ID NO: 10196 - protein, 120 aa, Artificial Sequence
  Description of Artificial Sequence: Synthetic polypeptide
EVQLLESGGGLVQPGGSLRLSCAASGFTFPTAEMLWVRKAPGKGLEWVSSISASGGSTYYADSVKGRFTISRDNSKNTLFLQMNSLRAEDTAVYYCAKEPVSYVATFDYWGQGTLVTVSS

SEQ ID NO: 10197 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKNTLYLQMNSLRAEDTAVYYCAKEPVSYVATFDYWGPGALVTVSS

SEQ ID NO: 10198 - protein, 120 aa, Artificial Sequence
  Description of Artificial Sequence: Synthetic polypeptide
EVQLLESGGGLVQPGGSLRLSCAASGFTFPTAEMLWVRQAPGKGLEWVSSISASGGSTYYADSVKGRFTISRDNSKNTLYLQMNSLRAEDTAVYYCAKEPVYYVATFDYWGQGTLVTVSS

SEQ ID NO: 10199 - protein, 113 aa, Artificial Sequence
  Description of Artificial Sequence: Synthetic polypeptide
EVQLLESGGGLVQPGGSLRLSCAASGFTFEDYRMVWVRQAPGGLEWVSSISTSGELTYYADSVGRFTISRDNSNTLYLQMNSLRAEDTAVYYCAETAGQFFDYGQGTLVTVSS

SEQ ID NO: 10200 - protein, 120 aa, Artificial Sequence
  Description of Artificial Sequence: Synthetic polypeptide
EVQLLESGGGLVQPGGSLRLSCAASGFTFPTAEMLWVRKAPGKGLEWVSSISASGGSTYYADSVKGRFTISRDNSKNTLYLQMNSLRAEDAAVYYCAKEPVSYVATFDYWGQGTLVTVSS

SEQ ID NO: 10201 - protein, 107 aa, Artificial Sequence
  Description of Artificial Sequence: Synthetic polypeptide
NIQMTQSPSSLSASVGDRVTITCRASHFIGTLLTWYQHKPGKAPKLLITYGSLLQSGVPSRFSGSGSGTDFTLTISSLQPEDFATYYCGQGVLWPATFGQGTKVEIR

SEQ ID NO: 10202 - protein, 107 aa, Artificial Sequence
  Description of Artificial Sequence: Synthetic polypeptide
DIQMTQSPSSLSASVGDRVTITCRASHFIGTLLSWYQQKPRKAPKLLITYGSLLQSGVPSRFSGSGSGTDFTLTISSLHPEDFATYYCGQGVLWPPTFGQGTVEIKR

SEQ ID NO: 10203 - protein, 108 aa, Artificial Sequence
  Description of Artificial Sequence: Synthetic polypeptide
DIQMTQSPSSLTASVGDRVTITCRASHFIGTLLSWYQQKPGKAPKLLVTYGSLLQSGVPSRFSGSGSGTDFTLTISNLQPEDFATYYCGQGVLWPPTFGQGTKVENIR

SEQ ID NO: 10204 - protein, 106 aa, Artificial Sequence
  Description of Artificial Sequence: Synthetic polypeptide
DIQMTQSPSSLSASVGDRVTITCRASHFIATLLSYQQPGKAPKLLITYGSLLQSGVPSRFSGSGSGTDFTLTISSLQPEDFATYYCGQGVLWPPTFGQGTKVEIKR

SEQ ID NO: 10205 - protein, 108 aa, Artificial Sequence
  Description of Artificial Sequence: Synthetic polypeptide
DIQMTQSPSFLSASVGDRVTITCRASHFIATLLSWYQQKPGKAPKLLITYGSLLQSGVPSRFSGSGSGTDFTLTISSLQPEDFATYYCGQGVLWPPTFGQGTKVEIKR

SEQ ID NO: 10206 - protein, 108 aa, Artificial Sequence
  Description of Artificial Sequence: Synthetic polypeptide
DIQMTQSPSSLSASVGDRVTITCRASHFIGTLLSWYQQKPGKATKLLITYGSLLQSGVPSRFSGSGSGTDFTLTISSLQPEDFATYYCGQGVLWPPTFGQGTKVEIKR

SEQ ID NO: 10207 - protein, 108 aa, Artificial Sequence
  Description of Artificial Sequence: Synthetic polypeptide
DIQMTQSPSSLSASVGDRVTITCRASHFIGSLLSWYQHKPGKAPKLLITYGSLLQSGVPSRFSGSGSGTDFTLTISSLQPEDFATYYCGQGVLWPATFGQGTKVEIKR

SEQ ID NO: 10208 - protein, 108 aa, Artificial Sequence
  Description of Artificial Sequence: Synthetic polypeptide
DIQMTQSPSSLSASVGDRVTITCRASHFIGTLLSWYQHKPGKAPKLLITYGSLLQSGVPSRFSGSGSGTDFTLTISSLQPEDFATYYCGQGVLWPATFGQGTKVEIKR

SEQ ID NO: 10209 - protein, 108 aa, Artificial Sequence
  Description of Artificial Sequence: Synthetic polypeptide
DIQMTQSPSSLSASVGDRVTITCRASHFIGTLLSWYQHKPGKAPKLLITYGSMLQSGVPSRFSGSGSGTDFTLTISSLQPEDFATYYCGQGVLWPATFGQGTKVEIKR

SEQ ID NO: 10210 - protein, 115 aa, Artificial Sequence
  Description of Artificial Sequence: Synthetic polypeptide
EVQLLESGGGLVQPGGSLRLSCAASGFTFPEYEMVWVRQAPGGLEWVSAISREGRATYYADSVKGRFTISRDNSKNTLYLQMNNLRAEDTAVYYCAKEPVRFDYWGQGTLVTVSS

SEQ ID NO: 10211 - protein, 108 aa, Artificial Sequence
  Description of Artificial Sequence: Synthetic polypeptide
DIQMTQSPSSLSASVGDRVTITCRASHFIGTLLSWYQHKPGKAPKLLITYGSLLQSGVPSRFSGSGSGTEFTLTISSLQPEDFATYYCGQGVLWPATFGQGTKVEIKR

SEQ ID NO: 10212 - protein, 108 aa, Artificial Sequence
  Description of Artificial Sequence: Synthetic polypeptide
DIQMTQSPSSLTASVGDRVTITCRASHFIGTLLSWYQHKPGKAPKLLITYGSLLQSGVPSRFSGSGSGTEFTLTISSLQPEDFATYYCGQGVLWPATFGQGTKVEIKR

SEQ ID NO: 10213 - protein, 108 aa, Artificial Sequence
  Description of Artificial Sequence: Synthetic polypeptide
NIQMTQSPSSLSASVGDRVTITCRASHFIGTLLSWYQHKPGKAPKLLITYGSLLQSGVPSRFSGSGSGTDFTLTISSLQPEDFATYYCGQGVLWPATFGQGTKVEIKR

SEQ ID NO: 10214 - protein, 108 aa, Artificial Sequence
  Description of Artificial Sequence: Synthetic polypeptide
DIQMTQSPSSLSASVGDRVTINCRASHFIGTLLSWYQHKPGKAPKLLITYGSLLQSGVPSRFSGSGSGTDFTLTISSLQPEDFATYYCGQGVLWPATFGQGTKVEIKR

SEQ ID NO: 10215 - protein, 108 aa, Artificial Sequence
  Description of Artificial Sequence: Synthetic polypeptide
DIQLTQSPSSLSASVGDRVTITCRASHFIGTLLSWYQQKPGKATKLLITYGSLLQSGVPSRFSGSGSGTDFTLTISSLQPEDFATYYCGQGVLWPPTFGQGTKVEIKR

SEQ ID NO: 10216 - protein, 108 aa, Artificial Sequence
  Description of Artificial Sequence: Synthetic polypeptide
DIQMTQSPSSLYASVGDRVTITCRVSHFIGTLLSWYQQKPGKAPKLLITYGSLLQSGVPSRFSGSGSGTDFTLSISSLQPEDFATYYCGQGVLWPPTFGQGTKVEIKQ

SEQ ID NO: 10217 - protein, 108 aa, Artificial Sequence
  Description of Artificial Sequence: Synthetic polypeptide
DIQMTQSPSSLSASVGDRVTITCRASHFIGTLLSWYQQKPRKAPKLLITYGSLLQSGVPSRFSGSGSGTDFTLTISSLQPEDFATYYCGQGVLWPPTFGQGTKVEIKR

SEQ ID NO: 10218 - protein, 108 aa, Artificial Sequence
  Description of Artificial Sequence: Synthetic polypeptide
DIQIIQSPSSLSASVGDRVTITCRASHFIGTLLSWYQQKPGKAPKLLITYGSLLQSGVPSRFSGSGSGTDFTLTISSLQPEDFATYYCGQGVLWPPTFGQGTKVEIKR

SEQ ID NO: 10219 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSLLQSGVPSRFSGSGSGTDFTLTISSLQPEDFATYYCGQGVLWPATFGQGTKVEIKR

SEQ ID NO: 10220 - protein, 107 aa, Artificial Sequence
  Description of Artificial Sequence: Synthetic polypeptide
DIQTQSPSSLSASVGDRVTITCRASHFIGTLLSWYQLKPGKAPKLLITYGSWLQSGVPSRFSGSGSGTDFTLTISSLQPEDFATYYCGQGVLWPATFGQGTKVENKR

SEQ ID NO: 10221 - protein, 115 aa, Artificial Sequence
  Description of Artificial Sequence: Synthetic polypeptide
EVQLLESGGGLVQPGGSLRLSCAASGFTFSTYEMLWVRQAPGGLEWVSSISSSGNYTYYADSVKGRFTISRDNSKNTLYLQMNSLRAEDTAVYYCAKEPLMFDYWGQGTLVTVSS

SEQ ID NO: 10222 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSLLQRGVPSRFSGSGSGTDFTLTISSLQPEDFATYYCGQGVLWPATFGQGTKVEIKR

SEQ ID NO: 10223 - protein, 108 aa, Artificial Sequence
  Description of Artificial Sequence: Synthetic polypeptide
DIQMTQAPSSLSASVGDRVTITCRASHFIGTLLSWYQLKPGKAPKLLITYGSLLQSGVPSRFSGSGSGTDFTLTISSLQPEDFATYYCGQGVLWPATFGQGTKVENKR

SEQ ID NO: 10224 - protein, 108 aa, Artificial Sequence
  Description of Artificial Sequence: Synthetic polypeptide
DIQMTQSPSSLSASVGDRVTITCRASHFIGSLLSWYQQKPGKAPKLLITYGSLLQSGVPSRFSGSGSGTDFALTISSLQPEDFATYYCGQGVLWPATFGQGTKVEIKR

SEQ ID NO: 10225 - protein, 108 aa, Artificial Sequence
  Description of Artificial Sequence: Synthetic polypeptide
DIQMTQSPSSLSASVGDRVTITCRASHFIGSLLSWYQVKPGKAPKLLITYGSLLQSGVPSRFSGSGSGTDFTLTISSLQPEDFATYYCGQGVLWPATFGQGTTVEIKR

SEQ ID NO: 10226 - protein, 106 aa, Artificial Sequence
  Description of Artificial Sequence: Synthetic polypeptide
DILMTQSPSSLSASVGDRVTITCRASHFIGSLLSWYQQPGAPKLLITYGSLLQSGVPSRFSGSGSGTDFTLTISSLQPEDFATYYCGQGVLWPATFGQGTKVEIKR

SEQ ID NO: 10227 - protein, 107 aa, Artificial Sequence
  Description of Artificial Sequence: Synthetic polypeptide
DIQTQSPSSLSASVGDRVTITCRASHFIGTLVSWYQQKPGKAPKLLITYGSLLQSGVPSRFSGSGSGTDFTLTISSLQPEDFATYYCGQGVLWPATYGQGTKVEIKR

SEQ ID NO: 10228 - protein, 107 aa, Artificial Sequence
  Description of Artificial Sequence: Synthetic polypeptide
DIQMTQSPSSLSASVGDRVTITCRASHFIGTLVSYQQKPGKAPKLLITYGSLLQSGVPSRFSGSGSGTDFTLTISSLQPEDFATYYCGQGVLWPATFGQGTKVENKR

SEQ ID NO: 10229 - protein, 108 aa, Artificial Sequence
  Description of Artificial Sequence: Synthetic polypeptide
DIKMTQSPSSLSASVGDRVTITCRASHFIGTLVSWYQQKPGKAPKLLITYGSMLQSGVPSRFSGSGSGTDFTLTISSLQPEDFATYYCGQGVLWPATFGQGTKVEIKR

SEQ ID NO: 10230 - protein, 108 aa, Artificial Sequence
  Description of Artificial Sequence: Synthetic polypeptide
DIQMTQSPSSLSASVGDRVTITCQASHFIGTLVSWYQQKPGKAPKLLITYGSLLQSGVPSRFSGSGSGTDFTLTISSLQPEDFATYYCGQGVLWPATFGQGTKVEIKR

SEQ ID NO: 10231 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSWLQSGVPSRFSGSGSGTDFTLTISSLQPEDFATYYCGQGVLWPATFGQGTKVEIKR

SEQ ID NO: 10232 - protein, 114 aa, Artificial Sequence
  Description of Artificial Sequence: Synthetic polypeptide
EVQLLESGGGLVQPGGSLRLSCAASGFTFDTEEMSWVRQAPGGLEWVSAISPNGAFTFYADSVKGRFTISRDNSKNTLYLQMNSLRAEDTAVYYCAKEILFDYWGQGTLVTVSS

SEQ ID NO: 10233 - protein, 108 aa, Artificial Sequence
  Description of Artificial Sequence: Synthetic polypeptide
DIQMTQSPSSLSASVGDRVTITCRASHFIGTLLSWYQLKPGKAPKLLITYGSWLQSGVPSRFSGSGSGTDFTLTISSLQPEDFATYYCGQGVLWPATFGQGTKVEIKR

SEQ ID NO: 10234 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSLLQSGVPSRFSGSGFGTDFTLTISSLQPEDFATYYCGQEVLWPATFGQGTKVEIKR

SEQ ID NO: 10235 - protein, 108 aa, Artificial Sequence
  Description of Artificial Sequence: Synthetic polypeptide
DIQMTQSPSSLSASVGDRVSITCRASHFIGTLLSWYQQKPGKAPKLLITYGSLLQSGVPSRFSGSGFGTDFTLTISSLQPEDLATYYCGQEVLWPATFGQGTKVEIKR

SEQ ID NO: 10236 - protein, 108 aa, Artificial Sequence
  Description of Artificial Sequence: Synthetic polypeptide
DIQMTQSPSSLSASVGDRVTITCQASHFIGTLLSWYQQKPGKAPKLLITYGSLLQSGVPSRFSGSGFGTDFTLTISSLQPEDFATYYCGQEVLWPATFGQGTKVEIKR

SEQ ID NO: 10237 - protein, 108 aa, Artificial Sequence
  Description of Artificial Sequence: Synthetic polypeptide
DIQMTQSPSSLSASVGDRVTITCRASHFIGTLLSWYQQKPGKAPKLLITYGSLLQSGVPSRFSGSGFGTEFTLTIGSLQPEDFATYYCGQGVLWPATFGQGTKVEIKR

SEQ ID NO: 10238 - protein, 108 aa, Artificial Sequence; identical to SEQ ID NO: 10206
  Description of Artificial Sequence: Synthetic polypeptide

SEQ ID NO: 10239 - protein, 108 aa, Artificial Sequence
  Description of Artificial Sequence: Synthetic polypeptide
DIQMTQSPSSLSASVGDRVTITCRASHFIASLLSWYQVKPGKAPKLLITYGSLLQSGVPSRFSGSGSGTDFTLTISSLQPEDFATYYCGQGVLWPATFGQGTTVEIKR

SEQ ID NO: 10240 - protein, 107 aa, Artificial Sequence
  Description of Artificial Sequence: Synthetic polypeptide
DIQTQSPSSLSASVGDRVTITCRASHFIAQLLSWYQVKPGKAPKLLITYGSLLQSGVPSRFSGSGSGTDFTLTISSLQPEDFATYYCGQGVLWPATFGQGTTVEIKR

SEQ ID NO: 10241 - protein, 108 aa, Artificial Sequence
  Description of Artificial Sequence: Synthetic polypeptide
DIQMTQSPSSLSASVGDRVTITCRASHFIAQLLSWYQVKPGKAPKLLITYGSLLQSGVPSRFSGSGSGTDFTLTISSLQPEDFATYYCGQGVLWPATFGQGTTVEIRR

SEQ ID NO: 10242 - protein, 108 aa, Artificial Sequence
  Description of Artificial Sequence: Synthetic polypeptide
DIQMTQSPSSLSASVGDRVTITCRASHYIASLLSWYQVKPGKAPKLLITYGSLLQSGAPSRFSGSGSGTDFTLTISSLQPEDFATYYCGQGVLWPATFGQGTTVEIKR

SEQ ID NO: 10243 - protein, 117 aa, Artificial Sequence
  Description of Artificial Sequence: Synthetic polypeptide
EVQLLESGGGLVQPGGSLRLSCAASGFTFGHYDMVWVRQAPGRGLEWVSTINGAGLNTYYADSVKGRFTISRDNSKNTLYLQMNSLRAEDTAVYYCAQSASRIFDYWGQGTLVTVSS

SEQ ID NO: 10244 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWASYLQSGVPSRFSGSGSGTDFTLTISSLQPEDFATYYCGQGVLWPATFGQGTTVEIKR

SEQ ID NO: 10245 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWTSYLQSGVPSRFSGSGSGTDFTLTISSLQPEDFATYYCGQGVLWPATFGQGTTVEIKR

SEQ ID NO: 10246 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWSSYLQSGVPSRFSGSGSGTDFTLTISSLQPEDFATYYCGQGVLWPATFGQGTTVEIKR

SEQ ID NO: 10247 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWGSWLQSGVPSRFSGSGSGTDFTLTISSLQPEDFATYYCGQGVLWPATFGQGTTVEIKR

SEQ ID NO: 10248 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWASWLQSGVPSRFSGSGSGTDFTLTISSLQPEDFATYYCGQGVLWPATFGQGTTVEIKR

SEQ ID NO: 10249 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWSSWLQSGVPSRFSGSGSGTDFTLTISSLQPEDFATYYCGQGVLWPATFGQGTTVEIKR

SEQ ID NO: 10250 - protein, 108 aa, Artificial Sequence
  Description of Artificial Sequence: Synthetic polypeptide
DIQMTQSPSSLSASVGDRVTITCRASHWIAQLLSWYQVKPGKAPKLLITYGSLLQSGVPSRFSGSGSGTDFTLTISSLQPEDFATYYCGQGVLWPATFGQGTTVEIKR

SEQ ID NO: 10251 - protein, 108 aa, Artificial Sequence
  Description of Artificial Sequence: Synthetic polypeptide
DIQMTQSPSSLSASVGDRVTITCRASHFIGSLLRWYQVKPGKAPKLLITYGSLLQSGVPSRFSGSGSGTDFTLTISSLQPEDFATYYCGQGVLWPATFGQGTTVEIKR

SEQ ID NO: 10252 - protein, 108 aa, Artificial Sequence
  Description of Artificial Sequence: Synthetic polypeptide
DIQMTQSPSSLSASVGDRVTITCRASHRIAQLLSWYQVKPGKAPKLLITYGSLLQSGVPSRFSGSGSGTDFTLTISSLQPEDFATYYCGQGVLWPATFGQGTTVEIKR

SEQ ID NO: 10253 - protein, 108 aa, Artificial Sequence
  Description of Artificial Sequence: Synthetic polypeptide
DIQMTQSPSSLSASVGDRVTITCRASHYIASLLSWYQVKPGKAPKLLITYGSLLQSGVPSRFSGSGSGTDFTLTISSLQPEDFATYYCGQGVLWPATFGQGTTVEIKR

SEQ ID NO: 10254 - protein, 116 aa, Artificial Sequence
  Description of Artificial Sequence: Synthetic polypeptide
EVQLLESGGGLVQPGGSLRLSCAASGSTIAGYEMWWVRQAPGKGLERVSAISGSGGSTYYADSVKGRFTISRDDSKNTLYLQMNSLRAEDTAVYYCARDPYSFDYWGQGTLVTVSS

SEQ ID NO: 10255 - protein, 115 aa, Artificial Sequence
  Description of Artificial Sequence: Synthetic polypeptide
EVQLLESGGGLVQPGGSLRLSCAASGFTFRSYEMAWVRQAPGKGLEWVSSISTLGTKTYYADSVKGRFTISRDNSKNTLYLQMNSLAEDTAVYYCAQSSTHIFDYWGQGTLTVSS

SEQ ID NO: 10256 - protein, 108 aa, Artificial Sequence
  Description of Artificial Sequence: Synthetic polypeptide
DIQMTQSPSSLSASVGDRVTITCRASHFIGSLLSWYQVKPGKAPKLLIRFGSLLQSGVPSRFSGSGSGTDFTLTISSLQPEDFATYYCGQGVLWPATFGQGTTVEIKR

SEQ ID NO: 10257 - protein, 108 aa, Artificial Sequence
  Description of Artificial Sequence: Synthetic polypeptide
DIQMTQSPSSLSASVGDRVTITCRASHFIGSLLSWYQVKPGKAPKLLITYKSYLQSGVPSRFSGSGSGTDFTLTISSLQPEDFATYYCGQGVLWPATFGQGTTVEIKR

SEQ ID NO: 10258 - protein, 108 aa, Artificial Sequence
  Description of Artificial Sequence: Synthetic polypeptide
DIQMTQSPSSLSASVGDRVTITCRASHFIGSLLSWYQVKPGKAPKLLITWGSYLQSGVPSRFSGSGSGTDFTLTISSLQPEDFATYYCGQGVLWPATFGQGTTVEIKR

SEQ ID NO: 10259 - protein, 108 aa, Artificial Sequence
  Description of Artificial Sequence: Synthetic polypeptide
DIQMTQSPSSLSASVGDRVTITCRASHFIWGPLSWYQVKPGKAPKLLITYGSLLQSGVPSRFSGSGSGTDFTLTISSLQPEDSATYYCGQGVLWPATFGQGTTVEIKR

SEQ ID NO: 10260 - protein, 108 aa, Artificial Sequence
  Description of Artificial Sequence: Synthetic polypeptide
DIQMTQSPSSLSASVGDRVTITCRASHWIATLLSWYQVKPGKAPKLLITYGSLLQSGVPSRFSGSGSGTDFTLTISSLQPEDFATYYCGQGVLWPATFGQGTTVEIKR

SEQ ID NO: 10261 - protein, 108 aa, Artificial Sequence
  Description of Artificial Sequence: Synthetic polypeptide
DIQMTQSPSSLSASVGDRVTITCRASHFIWGPLSWYQVKPGKAPKLLITYGSLLQSGVPSRFSGSGSGTDFTLTISSLQPEDFATYYCGQGVLWPATFGQGTTVEIKR

SEQ ID NO: 10262 - protein, 108 aa, Artificial Sequence
  Description of Artificial Sequence: Synthetic polypeptide
DIQMTQSPSSLSASVGDRVTITCRASHFIGSLLNWYQVKPGKAPKLLITYGSLLQSGVPSRFSGSGSGTDFTLTISSLQPEDFATYYCGQGVLWPATFGQGTTVEIKR

SEQ ID NO: 10263 - protein, 108 aa, Artificial Sequence
  Description of Artificial Sequence: Synthetic polypeptide
GIQMTQSPSSLSASVGDRVTITCRASHFIGSLLSWYQVKPGKAPKLLITYGSWLQSGVPSRFSGSGSGTDFTLTISSLQPEDFATYYCGQGVLWPATFGQGTTVEIKR

SEQ ID NO: 10264 - protein, 117 aa, Artificial Sequence
  Description of Artificial Sequence: Synthetic polypeptide
EVQLLESGGGLVQPGGSLRLSCAASGFTFIRYEMAWVRQAPGKGLEWVSSISSSGWTTYYADSVKGRFTISRDNSKNTLYLQMNSLRAEDTAVYYCAKSDAHIFDYWGQGTLVTVSS

SEQ ID NO: 10265 - protein, 116 aa, Artificial Sequence
  Description of Artificial Sequence: Synthetic polypeptide
EVQLLESGGGLVQPGGSLRLSCAASGFTFYAYEMAWVRQAPGGLEWVSSISDDGTRTYYADSVKGRFTISRDNSKNTLYLQMNSLRAEDTAVYYCAKDLGQGFDYWGQGTLVTVSS

SEQ ID NO: 10266 - protein, 117 aa, Artificial Sequence
  Description of Artificial Sequence: Synthetic polypeptide
EVQLLESGGGLVQPGGSLRLSCAASGFTFADHGMTWVRQAPGKGLEWVSGIGPSGEATYYADSVKGRFTISRDNSKNTLYLQMNSLAEDTAVYYCAKDRIPLVFDYWGQGTLVTVSS

SEQ ID NO: 10267 - protein, 115 aa, Artificial Sequence
  Description of Artificial Sequence: Synthetic polypeptide
EVQLLESGGGLVQPGGSLRLSCAASGFTFESQDMSWVRQAPGKGLEWVSGISPNGWDTYYADSVKGRFTISRDNSKNTLYLQMNSLRAEDTAVYYCAKDRSDFDYGQGTLVTVSS

SEQ ID NO: 10268 - protein, 116 aa, Artificial Sequence
  Description of Artificial Sequence: Synthetic polypeptide
EVQLLESGGGLVQPGGSLRLSCAASGFTFGDYDMWWVRQAPGGLEWVSRIRHPGGVTYYADSVKGRFTISRDNSKNTLYLQMNSLRAEDTAVYYCAKAVPKGFDYWGQGTLVTVSS

SEQ ID NO: 10269 - protein, 117 aa, Artificial Sequence
  Description of Artificial Sequence: Synthetic polypeptide
EVQLLESGGGLVQPGGSLRLSCAASGFTFRVYWMTWVRQAPGGLEWVSSIDPQGGMTYYADSVGRFTISRDNSKNTLYLQMNSLRAEDTAVYYCAKARIPNLEFDYWGQGTLVTVSS

SEQ ID NO: 10270 - protein, 118 aa, Artificial Sequence
  Description of Artificial Sequence: Synthetic polypeptide
EVQLLESGGGLVQPGESLRLSCAASGFTFSAYDMTWVRQAPGKGLEWVSRINPTGSYTYYADSVKGRFTISRDNSNTLYLQMNSLRAEDTAVYYCAKAKIPNLVFDYWGQGTLVTVSS

SEQ ID NO: 10271 - protein, 118 aa, Artificial Sequence
  Description of Artificial Sequence: Synthetic polypeptide
EVQLLESGGGLVQPGGSLRLSCAASGFTFADSEMMWVRQAPGKGLEVSGIAHNGGHTYYADSVGRFTISRDNSKNTLYLQMNSLRAEDTAVYYCAAGHPQQTEAFDYWGQGTLVTVSS

SEQ ID NO: 10272 - protein, 116 aa, Artificial Sequence
  Description of Artificial Sequence: Synthetic polypeptide
EMQLLESGGGLVQPGGSLRLSCAASGFTFATYDMYWVRQAPGKGLEWVSKISPNGWSTYYADSVKGRFTISRDNSKNTLYLQMNSLRAEDTAVYYCAKYQTHFDYWGQGTLVTVSS

SEQ ID NO: 10273 - protein, 115 aa, Artificial Sequence
  Description of Artificial Sequence: Synthetic polypeptide
EVQLLESGGGLVQPGGSLRLSCAASGFTFSVYDMRWVRQAPGKGLEWVSTISSSGTYTYYADSVGRFTISRDNSKNTLYLQMNSLRAEDTAVYYCAKYPKNFDYWGQGTLVTVSS

SEQ ID NO: 10274 - protein, 116 aa, Artificial Sequence
  Description of Artificial Sequence: Synthetic polypeptide
EVQLLESGGGLVQPGGSLRLSCAASGFTFSHEDMTWVRQAPGGLEWVSSISPNGWDTYYADSVKGRFTISRDNSKNTLYLQMNSLRAEDTAVYYCAKRTRSKFDYWGQGTLVTVSS

SEQ ID NO: 10275 - protein, 119 aa, Artificial Sequence
  Description of Artificial Sequence: Synthetic polypeptide
EVQLLESGGGLVQPGGSLRLSCAASGFTFEKYIMGWARQAPGKGLEMVSTIDYWGQHTYYADSVGRFTISRDNSKNTLYLQMNSLRAEDTAVYYCAKRSHLIPLQFDYWGQGTLVTVSS

SEQ ID NO: 10276 - protein, 120 aa, Artificial Sequence
  Description of Artificial Sequence: Synthetic polypeptide
EVQLLESGGGLVQPGGSLRLSCAASGFTFSDYAMGWVRQAPGGLEWVSTISYVGYYTYYADSVGRFTISRDNSKNTLYLQMNSLRAEDTAVYYCAKALRGEAFTERFDYWGQGTLVTVSS

SEQ ID NO: 10277 - protein, 121 aa, Artificial Sequence
  Description of Artificial Sequence: Synthetic polypeptide
EVQLLESGGGLVQPGGSLRLSCAASGFTFGPYMMHWVRQAPGKGLEWVSTIEVNGNRTYYADSVGRFTISRDNSKNTLYLQMNSLRAEDTAVYYCAKWVGSTSSDKSFDYWGQGTLVTVSS

SEQ ID NO: 10278 - protein, 119 aa, Artificial Sequence
  Description of Artificial Sequence: Synthetic polypeptide
EVQLLESGGGLVQPGGSLRLSCAASGFTFGTTEMAWVRQAPGGLEWVSSIGSAGAWTYYADSVKGRFTISRDNSKNTLYLQMNSLRAEDTAVYYCAKIGGHPQGQFDYWGQGTLVTVSS

SEQ ID NO: 10279 - protein, 117 aa, Artificial Sequence
  Description of Artificial Sequence: Synthetic polypeptide
EVQLLESGGGLVQPGGSLRLSCAASGFTFPREWMAWVRQAPGKGLEVSSIQPMGQTTYYADSVKGRFTISRDNSKNTLYLQMNSLRAEDTAVYYCAKYSRNKGFFDYGQGTLVTVSS

SEQ ID NO: 10280 - protein, 116 aa, Artificial Sequence
  Description of Artificial Sequence: Synthetic polypeptide
EVQLLESGGGLVQPGGSLRLSCAASGFTFTSEYMGWVRQAPGKGLEWVSSIQRYGSTTYYADSVKGRFTISRDNSNTLYLQMNSLRAEDTAVYYCAKHESNETFDYGQGTLVTVSS

SEQ ID NO: 10281 - protein, 119 aa, Artificial Sequence
  Description of Artificial Sequence: Synthetic polypeptide
EVQLLESGGGLVQPGGSLRLSCAASGFTFSVYSMQVRQAPGKGLEWVSAITPNGTRTYYADSVGRFTISRDNSNTLYLQMNSLRAEDTAVYYCATLGRGSYPGVDFDYWGQGTLVTVSS

SEQ ID NO: 10282 - protein, 116 aa, Artificial Sequence
  Description of Artificial Sequence: Synthetic polypeptide
EVQLLESGGGLVQPGGSLRLSCAASGFTFPSYAMTVRQAPGKGLEWVSRITADGTVTYYADSVGRFTISRDNSKNTLYLQMNSLRAEDTAVYYCAGSIPMLTFDYWGQGTLVTVSS

SEQ ID NO: 10283 - protein, 117 aa, Artificial Sequence
  Description of Artificial Sequence: Synthetic polypeptide
EVQLLESGGGLVQPGGSLRLSCAASGFTFSTYDMIVRQAPGKGLEWVSAISPNGTGIYYADSVKGRFTISRDNSKNTLYLQMNSLRAEDTAVYYCANQSVHHAVFDYGQGTLVTVSS

SEQ ID NO: 10284 - protein, 118 aa, Artificial Sequence
  Description of Artificial Sequence: Synthetic polypeptide
EVQLLESGGGLVQPGGSLRLSCAASGFTFENYEMTWVRQAPGKGLEIVSRIAPHGRLTYYADSVKGRFTISRDNSKNTLYLQMNSLRAEDTAVYYCAGQIPMLDFDYWGQGTLVTVSS

SEQ ID NO: 10285 - protein, 121 aa, Artificial Sequence
  Description of Artificial Sequence: Synthetic polypeptide
EVQLLESGGGLVQPGGSLRLSCAASGFTFSHYMMMWVRQAPGKGLEWVSTISHFGDITYYADSVKGRFTISRDNSKNTLYLQMNSLRAEDTAVYYCAKNDMVMKNGGFDYWGQGTLVTVSS

SEQ ID NO: 10286 - protein, 119 aa, Artificial Sequence
  Description of Artificial Sequence: Synthetic polypeptide
EVQLLESGGGLVQPGGSLRLSCAASGFTFERYDMSWVRQAPGKGLEWVSRIDSRGWSTYYADSVKGRFTISRDNSKNTLYLQMNSLRAEDTAVYYCAKGLVPHLRFDYWGQGTLVTVSS

SEQ ID NO: 10287 - protein, 116 aa, Artificial Sequence
  Description of Artificial Sequence: Synthetic polypeptide
EVQLLESGGGLVQPGGSLRLSCAASGFTFANAQMTWVRQAPGKGLEWVSRIDAMGDATYYADSVGRFTISRDNSKNTLYLQMNSLRAEDTAVYYCAKGKVPSIDYWGQGTLVTVSS

SEQ ID NO: 10288 - protein, 116 aa, Artificial Sequence
  Description of Artificial Sequence: Synthetic polypeptide
EVQLLESGGGLVQPGGSLRLSCAASGFTFANAQMTWVRQAPGKGLEWVSRIDAMGDATYYADSVGRFTISRDNSKNTLYLQMNSLRAEDTAVYYCAKGVIPAFDYWGQGTLVTVSS

SEQ ID NO: 10289 - protein, 116 aa, Artificial Sequence
  Description of Artificial Sequence: Synthetic polypeptide
EVQLLESGGGLVQPGGSLRLSCAASGFTFQNDRMHWVRQAPGKGLEWVSSISATGGDTYYADSVGRFTISRDNSKNTLYLQMNSLRAEDTAVYYCAQTGTNRFDYWGQGTLVTVSS

SEQ ID NO: 10290 - protein, 118 aa, Artificial Sequence
  Description of Artificial Sequence: Synthetic polypeptide
EVQLLESGGGLVQPGGSLRLSCAASGFTFNQPYMSWVRQAPGKGLEWVSSIDASGGTTYYADSVKGRFTISRDNSKNTLYLQMNSLRAEDAAVYYCAKDRIPNLVFDYGQGTLVTVSS

SEQ ID NO: 10291 - protein, 116 aa, Artificial Sequence
  Description of Artificial Sequence: Synthetic polypeptide
EVQLLESGGGLVQPGGSLRLSCAASGFTFDNENMTWVRQAPGKGLEWVSRIDGGGYNTYYADSVKGRFTISRDNSKNTLYLQNSLRAEDTAVYYCAGQVPELLFDYGQGTLVTVSS

SEQ ID NO: 10292 - protein, 117 aa, Artificial Sequence
  Description of Artificial Sequence: Synthetic polypeptide
EVQLLESGGGLVQPGGSLRLSCAASGFTFVSSNMTVRQAPGKGLEWVSAISGSGGSTYYADSVKGRFTISRDNSKNTLYLQMNSLRAEDTAVYYCAGRIPTLVFDYWGQGTLVTVSS

SEQ ID NO: 10293 - protein, 114 aa, Artificial Sequence
  Description of Artificial Sequence: Synthetic polypeptide
EVQLLESGGGLVQPGGSLRLSCAASGFTFRDYEMWWVRQAPGKGLERVSAINPQGTRTWADSVKGRFTISRDNSNTLYLQMNSLRAEDTAVYYCAKLPFYFQEWGQGTLVTVSS

SEQ ID NO: 10294 - protein, 118 aa, Artificial Sequence
  Description of Artificial Sequence: Synthetic polypeptide
EVQLLESGGGLVQPGGSLRLSCAASGFTFSDDSMSWVRQAPGGLEWVSRINDAGSSTYYADSVKGRFTISRDNSKNTLYLQMNSLRAEDTAVYYCAKGTIPLLEFDYWGQGTLVTVSS

SEQ ID NO: 10295 - protein, 115 aa, Artificial Sequence
  Description of Artificial Sequence: Synthetic polypeptide
EMQLLESGGGLVQPGGSLRLSCAASGFTFVSDTMSVRQAPGGLEVSRIDGTGGDTYYADSVKGRFTISRDNSKNTLYLQMNSLRAGDTAVYYCAGLIPDLQFDYWGQGTLVTVSS

SEQ ID NO: 10296 - protein, 118 aa, Artificial Sequence
  Description of Artificial Sequence: Synthetic polypeptide
EVQLLESGGGLVQPGGSLRLSCAASGFTFDEEEMTVRQAPGKGLEWVSRIIGGGHETYYADSVKGRFTISRDNSKNTLYLQMNSLRAEDTAVYYCAKGTIPLLEFDYWGQGTLVTVSS

SEQ ID NO: 10297 - protein, 118 aa, Artificial Sequence
  Description of Artificial Sequence: Synthetic polypeptide
EVQLLESGGGLVQPGGSLRLSCAASGFTFDIMEMMTVRQAPGKDLEWVSRITERGDVTYYADSVKGRFTISRDNSKNTLYLQMNSLRAEDTAVYYCAGTVPTLEFDYWGQGTLVTVSS

SEQ ID NO: 10298 - protein, 118 aa, Artificial Sequence
  Description of Artificial Sequence: Synthetic polypeptide
EVQLLESGGGLVQPGGSLRLSCAASGFTFDEEEMTVRQAPGKGLEWVSRIIGGGHETYYADSVKGRFTISRDNSKNTLYLQMNSLRAEDTAVYYCAKGTVPTLEFDYWGQGTLVTVSS

SEQ ID NO: 10299 - protein, 116 aa, Artificial Sequence
  Description of Artificial Sequence: Synthetic polypeptide
EVQLLESGGGLVQPGGSLRLSCAASGFTFHETEMTWVRQAPGGLEWVSAINRLGQDTYYADSVKGRFTISRDNSKNTLYLQMNSLRAEDTAVYYCAGRIPGLVFDYGQGTLVTVSS

SEQ ID NO: 10300 - protein, 119 aa, Artificial Sequence
  Description of Artificial Sequence: Synthetic polypeptide
EVQLLESGGGLVQPGGSLRLSCAASGFTFSDDSMSWVRQAPGKGLEWVSRINDAGSSTYYADSVKGRFTISRDNSKNTLYLQMNSLRAEDTAVYYCAKGTVPTLEFDYWGQGTLVTVSS

SEQ ID NO: 10301 - protein, 118 aa, Artificial Sequence
  Description of Artificial Sequence: Synthetic polypeptide
EVQLLESGGGLVQPGGSLRLSCAASGFTFDNENMTWVRQAPGKDLEWVSRITERGDVTYYADSVKGRFTISRDNSKNTLYLQMNSLRAEDTAVYYCAGRIPTLVFDYWGQGTLVTVSS

SEQ ID NO: 10302 - protein, 118 aa, Artificial Sequence
  Description of Artificial Sequence: Synthetic polypeptide
EVQLLESGGGLVQPGGSLRLSCAASGFTFSDDSMSWVRQAPGKGLEWVSRINDAGSSTYYADSVKGRFTISRDNSNTLYLQMNSLRAEDTAVYYCAKGITPNLTFDYWGQGTLVTVSS

SEQ ID NO: 10303 - protein, 108 aa, Artificial Sequence
  Description of Artificial Sequence: Synthetic polypeptide
DIQMTQSPSSLSASVGDRVTITCRASQSIGRRLNWYQQKPGKAPRLLIYLATRLQSGVPSRFSGSGSGTDFTLTISSLQPEDFATYYCHQYESPPLTFGQGTKVEIKR

SEQ ID NO: 10304 - protein, 118 aa, Artificial Sequence
  Description of Artificial Sequence: Synthetic polypeptide
EVQLLESGGGLVQPGGSLRLSCAASGFTFVSSNMTWVRQAPGKGLEWVSAISGSGGSTYYADSVKGRFTISRDNSKNTLYLQMNSLRAEDTAVYYCADRIPNLVFDYWGQGTLVTVSS

SEQ ID NO: 10305 - protein, 123 aa, Artificial Sequence
  Description of Artificial Sequence: Synthetic polypeptide
EVQLQQSGPELVKPGASVKISCKASGYTFTDYYMNWVKQSHGKSLEWIGDINPNNGDTSYNQKFKGKAPLTVDKSSSTAYMEVRSLTSEDSAVYFCARGGVLRYPYYYVMDYWGQGTSVTVSS

SEQ ID NO: 10306 - protein, 107 aa, Artificial Sequence
  Description of Artificial Sequence: Synthetic polypeptide
DIVMTQSQKFMSRSVGDRVSVTCKASQNVGPNVAWYQQRPGQSPKPLIYSASYRYSGVPDRFTGSGSGTDFTLTISNVQSEDLAEYFCQQYNNYPYTFGGGTKLEIK

SEQ ID NO: 10307 - protein, 124 aa, Artificial Sequence
  Description of Artificial Sequence: Synthetic polypeptide
EVQLQQSGAELVRPGASVKLSCTASGFNIKDDYMHWVKQRPEQGLEWIGWIDPENGHTKYASKFQGKATITADTSSNTAYLQLSSLTSEDTAVYYCTSLRHYYGSSYVSPHYYWGQGTTLTVSS

SEQ ID NO: 10308 - protein, 112 aa, Artificial Sequence
  Description of Artificial Sequence: Synthetic polypeptide
  MOD_RES (26)..(26): Any amino acid
  MOD_RES (28)..(28): Any amino acid
  MOD_RES (33)..(34): Any amino acid
DIVMTQAAPSVPVTPGESVSISCRSXKXLLHRXXNTYLYWFLQRPGQSPQLLIYRMSNLASGVPDRFSGSGSGTAFTLRISRVEAEDVGVYYCMQHLEFPFTFGGGTKLEIK

SEQ ID NO: 10309 - protein, 123 aa, Artificial Sequence
  Description of Artificial Sequence: Synthetic polypeptide
  MOD_RES (55)..(56): Any amino acid
EVQLQQSGPELVKPGASVKISCKASGYTFTDYYMNWVKQSHGKSLEWIGDINPNXXDTSYNQKFKGKAPLTVDKSSSTAYMEVRSLTSEDSAVYFCARGGVLRYPYYYVMDYWGQGTSVTVSS

SEQ ID NO: 10310 - protein, 124 aa, Artificial Sequence
  Description of Artificial Sequence: Synthetic polypeptide
  MOD_RES (52)..(53): Any amino acid
  MOD_RES (55)..(56): Any amino acid
EVQLQQSGAELVRPGASVKLSCTASGFNIKDDYMHWVKQRPEQGLEWIGWIXXEXXHTKYASKFQGKATITADTSSNTAYLQLSSLTSEDTAVYYCTSLRHYYGSSYVSPHYYWGQGTTLTVSS

SEQ ID NO: 10311 - protein, 68 aa, Artificial Sequence
  Description of Artificial Sequence: Synthetic polypeptide
DVVMTQNPLSLPVSLGDQASISCRSSQSLIYNNGNTYLHWYRQKPGQSPKLLIYKVSNRFSGVPDRFS

SEQ ID NO: 10312 - protein, 114 aa, Artificial Sequence
  Description of Artificial Sequence: Synthetic polypeptide
EVQLVESGGGLVKPGGSLKLSCAASGFTFSDYGMLWVRQAPEKGLEWIAYISSGSSTIYYADRVKGRFTISRDNAKNTLFLQMTSLRSEDTAMYYCSTGTFAYWGQGTPVTVSS

SEQ ID NO: 10313 - protein, 112 aa, Artificial Sequence
  Description of Artificial Sequence: Synthetic polypeptide
DIVMTQAAPSVPVTPGESVSISCRSNKSLLHRNGNTYLYWFLQRPGQSPQLLIYRMSNLASGVPDRFSGSGSGTAFTLRISRVEAEDVGVYYCMQHLEFPFTFGGGTKLEIK

SEQ ID NO: 10314 - protein, 97 aa, Artificial Sequence
  Description of Artificial Sequence: Synthetic polypeptide
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTF

SEQ ID NO: 10315 - protein, 111 aa, Artificial Sequence
  Description of Artificial Sequence: Synthetic polypeptide
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVW

SEQ ID NO: 10316 - protein, 97 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTF

SEQ ID NO: 10317 - protein, 111 aa, Artificial Sequence
  Description of Artificial Sequence: Synthetic polypeptide
QVQLQQPGAELVKAGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVW

SEQ ID NO: 10318 - protein, 241 aa, Artificial Sequence
  Description of Artificial Sequence: Synthetic polypeptide
EVQLVESGGGLVQPGGSLRLSCAASGFTFSSYAMSWVRQAPGKGLEWVSAISGSGGSTYYADSVKGRFTISRDNSKDTLYLQMSSLKTEDTAVYYCARGSLLQFWGQGTLVTASRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGAAA

SEQ ID NO: 10319 - protein, 446 aa, Artificial Sequence
  Description of Artificial Sequence: Synthetic polypeptide
EVQLVESGGGLVQPGGSLRLSCAASGFFITNNYWGWVRQAPGKGLEWVGYISYSGSTSYNPSLKSRFTISRDTSKNTFYLQMNSLRAEDTAVYYCARTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10320 - protein, 350 aa, Artificial Sequence
  Description of Artificial Sequence: Synthetic polypeptide
RTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10321 - protein, 494 aa, Artificial Sequence
  Description of Artificial Sequence: Synthetic polypeptide
MALPVTALLLPLALLLHAARPGSDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSASSGTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10322 - protein, 244 aa, Artificial Sequence
  Description of Artificial Sequence: Synthetic polypeptide
DIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSSGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSS

SEQ ID NO: 10323 - protein, 121 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGQGTTVTVSS

SEQ ID NO: 10324 - protein, 102 aa, Artificial Sequence
  Description of Artificial Sequence: Synthetic polypeptide
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTK

SEQ ID NO: 10325 - protein, 510 aa, Artificial Sequence
  Description of Artificial Sequence: Synthetic polypeptide
QVQLVQSGAELVKPGASVKMSCKASGYTFTSYNMHWVKQTPGQGLEWIGAIYPGNGDTSYNQKFKGKATLTADKSSSTAYMQLSSLTSEDSAVYYCARAQLRPNYWYFDVWGAGTTVTVSSGGGGSGGGGSGGGGSGGGGSGGGGSDIVLSQSPAILSASPGEKVTMTCRASSSVSYMHWYQQKPGSSPKPWIYATSNLASGVPARFSGSGSGTSYSLTISRVEAEDAATYYCQQWISNPPTFGAGTKLELKGGGGSGGKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 10326 - protein, 512 aa, Artificial Sequence
  Description of Artificial Sequence: Synthetic polypeptide
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAGSTSGSGKPGSGEGSTKGQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKEFPKPSTPPGSSGGAPKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 10327 - protein, 520 aa, Artificial Sequence
  Description of Artificial Sequence: Synthetic polypeptide
QVQLQQPGAELVKPGASVKMSCKTSGYTFTSYNVHWVKQTPGQGLEWIGAIYPGNGDTSFNWKFKGKATLTADKSSSTVYMQLSSLTSEDSAVYYCARSNYYGSSYVWFFDVWGAGTTVTVSSGSTSGSGKPGSGEGSQIVLSQSPTILSASPGEKVTMTCRASSSVSYMDWYQQKPGSSPKPWIYATSNLASGVPARFSGSGSGTSYSLTISRVEAEDAATYYCQQWISNPPTFGAGTKLELKEFPKTSTPPGSSGGAPGILGFVFTLKEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVAR

SEQ ID NO: 10328 - protein, 504 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 10329 - protein, 504 aa, Artificial Sequence
  Description of Artificial Sequence: Synthetic polypeptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 10330 - protein, 296 aa, Artificial Sequence
  Description of Artificial Sequence: Synthetic polypeptide
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 10331 - protein, 232 aa, Artificial Sequence
  Description of Artificial Sequence: Synthetic polypeptide
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 10332 - protein, 261 aa, Artificial Sequence
  Description of Artificial Sequence: Synthetic polypeptide
MPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 10333 - protein, 197 aa, Artificial Sequence
  Description of Artificial Sequence: Synthetic polypeptide
MPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 10334 - protein, 230 aa, Artificial Sequence
  Description of Artificial Sequence: Synthetic polypeptide
HHHHHHQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 10335 - protein, 166 aa, Artificial Sequence
  Description of Artificial Sequence: Synthetic polypeptide
HHHHHHQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKESLELEDPSSGLGVTKQDLGPVPM

SEQ ID NO: 10336 - protein, 502 aa, Artificial Sequence
  Description of Artificial Sequence: Synthetic polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHH

SEQ ID NO: 10337 - protein, 141 aa, Artificial Sequence
  Description of Artificial Sequence: Synthetic polypeptide
MSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 10338 - protein, 672 aa, Artificial Sequence
  Description of Artificial Sequence: Synthetic polypeptide
EVQLQQSGPDLVKPGASVKISCKASGYSFTGYYMHWVKQSPGKGLEWIGRINPNNGVTLYNQKFKDKATLTVDKSSTTAYMELRSLTSEDSAVYYCARSTMITNYVMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDSGGPSEKSEEINEKDLRKKSELQGTALGNLKQIYYYNSKAITSSEKSADQFLTNTLLFKGFFTGHPWYNDLLVDLGSTAATSEYEGSSVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNTTISSTSLSISLYLYTTSIVMTQTPTSLLVSAGDRVTITCKASQSVSNDVAWYQQKPGQSPKLLISYTSSRYAGVPDRFSGSGYGTDFTLTISSVQAEDAAVYFCQQDYNSPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNES

SEQ ID NO: 10339 - protein, 456 aa, Artificial Sequence
  Description of Artificial Sequence: Synthetic polypeptide
METGLRWLLLVAVLKGVHCQSLEESGGGLVKPGASLTLTCTASGFSFSNNDWMCWVRQAPGKGLEWIACIYGGSSIGTNYAGWAKGRFTISRTSSTTVALQMTSLTVADTATYFCTRDLANLWGPGTLVSVSSGQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPMCPPPELLGGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPTVLDSDGSYFLYSKLSVPTSEWQRGDVFTCSVMHEALHNHYTQKSISRSPGK

SEQ ID NO: 10340 - protein, 238 aa, Artificial Sequence
  Description of Artificial Sequence: Synthetic polypeptide
MDMRAPTQLLGLLLLWLPGATFAQVLTQTPSSVSAAVGGTVTINCQSSQSVYSDWLSWYQQKGGQPPRQLIYEASKLASGVPSRFSGSGSGTQFTLTINDVQCDDAATYYCLASYDCTRADCLAFGGGTEVVVRGDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 10341 - protein, 451 aa, Artificial Sequence
  Description of Artificial Sequence: Synthetic polypeptide
METGLRWLLLVAVLKGVQCQSVEESGGRLVTPGTPLTLTCTVSGFSLNTYGVSWVRQAPGKGLEWIGYIFTDGQTYYASWAKGRFTISKTSSTTVDLKITSPTTEDTATYFCASVDIWGPGTPVTVSSGQPKAPSVFPLAPCCGDTPSSTVTLGCLVKGYLPEPVTVTWNSGTLTNGVRTFPSVRQSSGLYSLSSVVSVTSSSQPVTCNVAHPATNTKVDKTVAPSTCSKPTCPPPELLGGPSVFIFPPKPKDTLMISRTPEVTCVVVDVSQDDPEVQFTWYINNEQVRTARPPLREQQFNSTIRVVSTLPIAHQDWLRGKEFKCKVHNKALPAPIEKTISKARGQPLEPKVYTMGPPREELSSRSVSLTCMINGFYPSDISVEWEKNGKAEDNYKTTPAVLDSDGSYFLYSKLSVPTSEWQRGDVFTCSVMHEALHNHYTQKSISRSPGK

SEQ ID NO: 10342 - protein, 238 aa, Artificial Sequence
  Description of Artificial Sequence: Synthetic polypeptide
MDMRAPTQLLGLLLLWLPGATFAQVLTQTPSPVSAAVGSTVTIKCQSSPSVYSNYLSWYQQKSGQPPKQLIYDASHLASGVPSRFSGSGSGTQFTLTISGVQCDDAATYYCLGSYDCSSVDCHAFGGGTEVVVKGDPVAPTVLIFPPAADQVATGTVTIVCVANKYFPDVTVTWEVDGTTQTTGIENSKTPQNSADCTYNLSSTLTLTSTQYNSHKEYTCKVTQGTTSVVQSFNRGDC

SEQ ID NO: 10343 - protein, 126 aa, Artificial Sequence
  Description of Artificial Sequence: Synthetic polypeptide
  Variable chain of single chain antibody
EAQLVQSGAEGKKPGSSVKVSCKAPGGTFNSYAISWVRQAPGQGLEWMGGIIPIFGTAYYAQKFQGRVTITADESTSTAYMELSSLRSEDTAVYYCAREEGPYCSSTSCYAAFDIWGRGTLVTVSS

SEQ ID NO: 10344 - protein, 126 aa, Artificial Sequence
  Description of Artificial Sequence: Synthetic polypeptide
  Variable chain of single chain antibody
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYAAFDIWGQGTLVTVSS

SEQ ID NO: 10345 - protein, 126 aa, Artificial Sequence
  Description of Artificial Sequence: Synthetic polypeptide
  Variable chain of single chain antibody
EVQLVQSGAEVKKPGSSVKVSCKASGGTFSSYAISWVRQAPGQGLEWVGGIIPIFGTANYAQKFQGRVKITADESASTAYMELSSLRSEDTAVYYCAREEGPYCSSTSCYAAFDIWGQGTLVTVSS

SEQ ID NO: 10346 - protein, 112 aa, Homo sapiens
  MOD_RES (35)..(36): Any amino acid
  MOD_RES (39)..(39): Any amino acid
  MOD_RES (99)..(99): Any amino acid
DIVMTQSPLSLPVTPGEPASISCRSSQSLLHSDGXXYLXWYLQKPGQSPQLLIYLVSNRASGVPDRFSGSGSGTDFTLKISRVEAEDVGVYYCMQALQXPRTFGQGTKVEIK

SEQ ID NO: 10347 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10348 - protein, 326 aa, Homo sapiens; identical to SEQ ID NO: 3049

SEQ ID NO: 10349 - protein, 377 aa, Homo sapiens; identical to SEQ ID NO: 5341

SEQ ID NO: 10350 - protein, 120 aa, Artificial Sequence
  Description of Artificial Sequence: Synthetic polypeptide
  Rat-human chimeric polypeptide
QVQLVQSGAEVKKPGSSVKVSCKASGFTFTDYAISWVRQAPGQGLEWMGGINPNSGYSTYAQKFQGRVTITADKSTSTAYMELSSLRSEDTAVYYCARLSPGGYYVMDAWGQGTTVTVSS

SEQ ID NO: 10351 - protein, 260 aa, Artificial Sequence
  Description of Artificial Sequence: Synthetic polypeptide
  A12 cys-diabody sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKSSSSWYRSYYFDYWGQGTLVTVSSGGGGGSQSALTQDPAVSVALGQTVRITCRGDSLRNYYASWYQQKPGQAPVLVIYGKNNRPSGIPDRFSGSFSGNTASLTITGAQAEDEADYYCNSRDSSANQMFGGGTKVTVLGAAAEQKLISEEDLNGAAHHHHHHC

SEQ ID NO: 10352 - protein, 259 aa, Artificial Sequence
  Description of Artificial Sequence: Synthetic polypeptide
  C2 cys-diabody sequence
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCASQHVGEQSRYFDYWGQGTLVTVSSGGGGGSDIVMTQSPSSLSASIGDRVTITCRASHSISSYVNWYQKKPGKAPNLLIYAASYLPRGVPSRFSGSGLGTDFTLTISNLQPEDFATYYCQESYSTPYSFGQGTKVDIKRAAAEQKLISEEDLNGAAHHHHHHC

SEQ ID NO: 10353 - protein, 255 aa, Artificial Sequence
  Description of Artificial Sequence: Synthetic polypeptide
  E9 cys-diabody sequence
QVQLQESGGGVVQPGRSLRLSCAASGFTFSSYGMHWVRQAPGKGLEWVSAIGSSGGSTHDADTVKGRFTISRDNAKNSLYLQMNSLRAEDTAVYYCARDRARGFDYWGQGTLVTVSSGGGGGSEIVLTQSPSTLSASIGDRVTITCRASQGISSYLAWYQQKPGKAPKLLIYGASSLQSGVPSRFSGRGSGADFTLTISSLQPEDFATYYCQQLISYPLTFGGGTKVEIKRAAAEQKLISEEDLNGAAHHHHHHC

SEQ ID NO: 10354 - protein, 255 aa, Artificial Sequence
  Description of Artificial Sequence: Synthetic polypeptide
  F1 cys-diabody sequence
QVQLVQSGAEVKKPGASVKVSCKASGYTFTDYYMHWVRQAPGEGLEWMGWMNPNSGGTNYAQKFQGRVTMTRDTSISTAYMELSRLRSDDTAVYYCARSHYWDSWSPGTLVTVSSGGGGGSSALTQPASVSGSPGQSITISCTGTSGDVGGYNYVSWYQQHPGKAPKLMIYDVSNRPSGVSNRFSGSKSGNTASLTISGLQAEDEADYYCTSYAGSRNLVFGGGTKLTVLGAAAEQKLISEEDLNGAAHHHHHHC

SEQ ID NO: 10355 - protein, 257 aa, Artificial Sequence
  Description of Artificial Sequence: Synthetic polypeptide
  F11 cys-diabody sequence
QVQLQESGGGLLQPGGSLRLSCAASRFTFSNYAMSWVRQAPGKGLEWVSAISGSGASTYYADSVKGRFTISRDNSKNTLYLQMNSLRAEDTAVYYCSNLYGDYDYWGQGTLVTVSSGGGGGSQSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVLGAAAEQKLISEEDLNGAAHHHHHHC

SEQ ID NO: 10356 - protein, 269 aa, Artificial Sequence
  Description of Artificial Sequence: Synthetic polypeptide
  G1 cys-diabody sequence
QVQLQESGGGVVQPGGSLRLSCAASGFTFSSYSMNWVRQAPGKGLEWVSSISSSSSYIYYADSVKGRFTISRDNAKNSLYLQMNSLRAEDTAVYYCARDLPSDDYGDYDYYYYGMDVWGQGTTVTVSSGGGGGSQSVLTQPPSASGTPGQRVTLFCSGSSSNIASNSVKWYQQPPQRAPKLLMFSDDQRPSGVPVRFSASKSGTSASLAISGLQSEDEADYYCAAWDDSLNAEVFGGGTKVTVLGAAAEQKLISEEDLNGAAHHHHHHC

SEQ ID NO: 10357 - protein, 258 aa, Artificial Sequence
  Description of Artificial Sequence: Synthetic polypeptide
  H2 cys-diabody sequence
EVQLVESGGGLVQPGGSLRLSCAASGFTFSTYAMSWVRQAPGKGLEWVSAISGSGGSTYYADSVKGRFTISRDNSKNTLYLQMNSLRAEDTAVYYCAREGGKWYYGMDVWGRGTLVTVSSGGGGGSSSELTQDPAVSVALGQTVRITCQGDSLRSYYTNWFQQKPGQAPLLVVYAKNKRPSGIPDRFSGSGSGDTASLTITGAQAEDEADYYCNSRDSSGNYLFAAGTKLTVLGAAAEQKLISEEDLNGAAHHHHHHC

SEQ ID NO: 10358 - protein, 259 aa, Artificial Sequence
  Description of Artificial Sequence: Synthetic polypeptide
  H5 cys-diabody sequence
QVQLQESGGGLVQPGGSLRLSCAASGFTFSNYAMSWVRQAPGKGLEWVSAISGSGGSTYYADSVKGRFTISRDNSKNTLYLQMNSLRAEDTAVYYCAKDRFRAAAYWGQGTLVTVSSGGGGGSQSVLTQPPSVSAAPGQKVTISCTGSSSNIGAGYDVHWYQQLPGTAPKLLIYGNSNRPSGVPDRFSGSKSGTSASLAISGLQSEDEADYYCAAWDDILNGEIFGGGTKVTVLGAAAEQKLISEEDLNGAAHHHHHHC

SEQ ID NO: 10359 - protein, 118 aa, Homo sapiens
GVQLLESGGGLVQPGGSLRLSCAASGFTFAWYDMGWVRQAPGKGLEWVSSIDWHGEVTYYADSVKGRFTISRDNSKNTLYLQMNSLRAEDTAVYYCATAEDEPGYDYWGQGTLVTVSS

SEQ ID NO: 10360 - protein, 118 aa, Homo sapiens
GVQLLESGGGLVQPGGSLRLSCAASGFVFPWYDMGWVRQAPGKGLEWVSSIDWHGKITYYADSVKGRFTISRDNSKNTLYLQMNSLRAEDTAVYYCATAEDEPGYDYWGQGTLVTVSS

SEQ ID NO: 10361 - protein, 108 aa, Homo sapiens
DIQMTQSPSSLSASVGDRVTITCRASRPISDWLHWYQQKPGKAPKLLIAWASTLDSGVPSRFSGSGSGTDFTLTISSLQPEDFATYYCLQEGWGPPTFGQGTKVEIKR

SEQ ID NO: 10362 - protein, 108 aa, Homo sapiens
DIQMTQSPSSLSASVGDRVTITCRASRPISDWLHWYQQKPGKAPKLLIAWASSLYEGVPSRFSGSGSGTDFTLTISSLQPEDFATYYCLQEGWGPPTFGQGTKVEIKR

SEQ ID NO: 10363 - protein, 108 aa, Homo sapiens
DIQMTQSPSSLSASVGDRVTITCRASRPISDWLHWYQQKPGKAPKLLIAWASSLQGGVPSRFSGSGSGTDFTLTISSLQPEDFATYYCLQEGWGPPTFGQGTKVEIKR

SEQ ID NO: 10364 - protein, 116 aa, Homo sapiens
EVQLLESGGGLVQPGGSLRLSCAASGFTFRNFGMGWVRQAPGKGLEWVSWIISSGTETYYADSVKGRFTISRDNSKNTLYLQMNSLRAEDTAVYYCAKSLGRFDYWGQGTLVTVSS

SEQ ID NO: 10365 - protein, 108 aa, Homo sapiens
DIQMTQSPSSLSASVGDRVTITCRASRPISDWLHWYQQKPGKAPKLLIAWASSLQGGVPSRFSGSGSGTDFTLTISSLQPEDFATYYCQQEGWGPPTFGQGTKVEIKR

SEQ ID NO: 10366 - protein, 116 aa, Artificial Sequence
  Description of Artificial Sequence: Synthetic polypeptide
  B2M-aTacVL
QVHLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSS

SEQ ID NO: 10367 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10368 - protein, 231 aa, Homo sapiens; identical to SEQ ID NO: 4639

SEQ ID NO: 10369 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10370 - protein, 230 aa, Artificial Sequence
  Description of Artificial Sequence: Synthetic polypeptide
  Recombinant Polypeptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10371 - protein, 228 aa, Artificial Sequence
  Description of Artificial Sequence: Synthetic polypeptide
  Recombinant Polypeptide
KTHTCPPCPAPELLGGPSVFLFPPALEDLLLGSEANVTCVVVDVSHEDPEVKFNWYVDGVEVHNAKTKPREEQYNSTYRVVSVLTVLHQDWLNGKEYKCKVSNKALPAPIEKTISKAKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10372 - protein, 230 aa, Artificial Sequence
  Description of Artificial Sequence: Synthetic polypeptide
  Recombinant Polypeptide
DKTHTCPPCPAPELLGGPSVFLFPPALEDLLLGSEANGVTCVVVDVSHEDPEVKFNWYVDGVEVHNAKTKPREEQYNSTYRVVSVLTVLHQDWLNGKEYKCKVSNKALPAPIEKTISKAKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10373 - protein, 218 aa, Homo sapiens
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10374 - protein, 221 aa, Artificial Sequence
  Description of Artificial Sequence: Synthetic polypeptide
  Recombinant Polypeptide
PAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10375 - protein, 220 aa, Artificial Sequence
  Description of Artificial Sequence: Synthetic polypeptide
  Recombinant Polypeptide
PAPELLGGPSVFLFPPALEDLLLGSEANVTCVVVDVSHEDPEVKFNWYVDGVEVHNAKTKPREEQYNSTYRVVSVLTVLHQDWLNGKEYKCKVSNKALPAPIEKTISKAKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10376 - protein, 221 aa, Artificial Sequence
  Description of Artificial Sequence: Synthetic polypeptide
  Recombinant Polypeptide
PAPELLGGPSVFLFPPALEDLLLGSEANGVTCVVVDVSHEDPEVKFNWYVDGVEVHNAKTKPREEQYNSTYRVVSVLTVLHQDWLNGKEYKCKVSNKALPAPIEKTISKAKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10377 - protein, 353 aa, Artificial Sequence
  Description of Artificial Sequence: Synthetic polypeptide
  Recombinant Polypeptide
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 10378 - protein, 340 aa, Homo sapiens
ASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCPVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRMAGKPTHVNVSVVMAEVDGTCY

SEQ ID NO: 10379 - protein, 344 aa, Mus musculus
ESARNPTIYPLTLPPALSSDPVIIGCLIHDYFPSGTMNVTWGKSGKDITTVNFPPALASGGRYTMSNQLTLPAVECPEGESVKCSVQHDSNPVQELDVNCSGPTPPPPITIPSCQPSLSLQRPALEDLLLGSDASITCTLNGLRNPEGAVFTWEPSTGKDAVQKKAVQNSCGCYSVSSVLPGCAERWNSGASFKCTVTHPESGTLTGTIAKVTVNTFPPQVHLLPPPSEELALNELLSLTCLVRAFNPKEVLVRWLHGNEELSPESYLVFEPLKEPGEGATTYLVTSVLRVSAETWKQGDQYSCMVGHEALPMNFTQKTIDRLSGKPTNVSVSVIMSEGDGICY

SEQ ID NO: 10380 - protein, 299 aa, Oryctolagus cuniculus
QSGTSGPYTACSELILPVTQCLGQKSAACHVEYNSVINESLPVPFPDCCPANSCCTCPSSSSRNLISGCQPSLSLQRPDLGDLLLGRDASLTCTLSGLKNPEDAVFTWEPTNGNEPVQQRAQRDLSGCYSVSSVLPSSAETWKARTEFTCTVTHPEIDSGSLTATISRGVVTPPQVHLLPPPSEELALNEQVTLTCLVRGFSPKDVLVSWRHQGQEVPEDSFLVWKSMPESSQDKATYAITSLLRVPAEDWNQGDTYSCMVGHEGLAEHFTQKTIDRLAGKPTHVNVSVVVADVEAVCY

SEQ ID NO: 10381 - protein, 353 aa, Gorilla gorilla
ASPTSPKVFPLSLCSTQPDGDVVVACLVQGFFPQEPLSVTWSESGQGVTARNFPPSQDASGDLYTTSSQLTLPATQCPDGKSVTCHVNHYTNPSQDVTVPCRVPSTPPTPSPSTPPTPSPPCCHPRLSLHRPALEDLLLGSEANLTCTLTGLRDASGVTFTWTPSSGKSAVEGPPERDLCGCYSVSSVLPGCAEPWNHGKTFTCTAAYPESKTPLTATLSKSGNMFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 10382 - protein, 337 aa, Sus scrofa
SETSPKIFPLTLGSSEPAGYVVIACLVRDFFPSEPLTVTWSPSREGVIVRNFPPAQAGGLYTMSSQLTLPVEQCPADQILKCQVQHLSKSSQSVNVPCKDPCPQCCKPSLSLQPPALADLLLGSNASLTCTLSGLKKSEGVSFTWQPSGGKDAVQASPTRDSCGCYSVSSILPGCADPWNKGETFSCTAAHSELKSALTATITKPKVNTFRPQVHLLPPPSEELALNELVTLTCLVRGFSPKDVLVRWLQGGQELPRDKYLVWESLPEPGQAIPTYAVTSVLRVDAEDWKQGDTFSCMVGHEALPLAFTQKTIDRLAGKPTHVNVSVVMAEAEGICY

SEQ ID NO: 10383 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10384 - protein, 222 aa, Artificial Sequence
  Description of Artificial Sequence: Synthetic polypeptide
CPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 10385 - protein, 363 aa, Artificial Sequence
  Description of Artificial Sequence: Synthetic polypeptide
  scFvCD19-DmrA protein
MGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEG

SEQ ID NO: 10386 - protein, 363 aa, Artificial Sequence
  Description of Artificial Sequence: Synthetic polypeptide
  scFvCD19-DmrB protein
MGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEG

SEQ ID NO: 10387 - protein, 349 aa, Artificial Sequence
  Description of Artificial Sequence: Synthetic polypeptide
  scFvCD19-DmrC protein
MGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSILWHEMWHEGLEEASRLYFGERNVKGMFEVLEPLHAMMERGPQTLKETSFNQAYGRDLMEAQEWCRKYMKSGNVKDLLQAWDLYYHVFRRISKG

SEQ ID NO: 10388 - protein, 324 aa, Artificial Sequence
  Description of Artificial Sequence: Synthetic polypeptide
  DmrC-TM-41BB-CD3z protein
MGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 10389 - protein, 338 aa, Artificial Sequence
  Description of Artificial Sequence: Synthetic polypeptide
  DmrB-TM-41BB-CD3z protein
MGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 10390 - protein, 338 aa, Artificial Sequence
  Description of Artificial Sequence: Synthetic polypeptide
  DmrA-TM-41BB-CD3z protein
MGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 10391 - protein, 570 aa, Artificial Sequence
  Description of Artificial Sequence: Synthetic polypeptide
  SS-2xDmrB-DmrC-TM-41BB-CD3z protein
MALPVTALLLPLALLLHAARPGSGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVEFLKLESGTSGTSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGSRSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 10392 - protein, 742 aa, Artificial Sequence
  Description of Artificial Sequence: Synthetic polypeptide
  SS-scFvCD19-DmrA-fuP2A-DmrC-TM-41BB-CD3z protein
METDTLLLWVLLLWVPGSTGDYKDEGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGSGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRARYKRSVSGSGATNFSLLKQAGDVEENPGPSRSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGS

SEQ ID NO: 10393 - protein, 741 aa, Artificial Sequence
  Description of Artificial Sequence: Synthetic polypeptide
  SS-scFvCD19-DmrA-fuP2A-FRB-TM-41BB-CD3z protein
METDTLLLWVLLLWVPGSTGDYKDEGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGSGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRARYKRSVSGSGATNFSLLKQAGDVEENPGPSRSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 10394 - protein, 967 aa, Artificial Sequence
  Description of Artificial Sequence: Synthetic polypeptide
  SS-scFvCD19-DmrA-fuP2A-2xDmrB-DmrC-TM-41BB-CD3z protein
METDTLLLWVLLLWVPGSTGDYKDEGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGSGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRARYKRSVSGSGATNFSLLKQAGDVEENPGPSRSGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVEFLKLESGTSGTSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGSRSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRG

SEQ ID NO: 10395 - protein, 406 aa, Artificial Sequence
  Description of Artificial Sequence: Synthetic polypeptide
  SS-CD19scFv-DmrA-CD4TM protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFF

SEQ ID NO: 10396 - protein, 453 aa, Artificial Sequence
  Description of Artificial Sequence: Synthetic polypeptide
  SS-CD19scFv-DmrA-CD8hingeTM protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRAKPTTTPAPRPPTPAPTIASQPLSLRPEACRPAAGGAVHTRGLDFACDIYIWAPLAGTCGVLLLSLVIT

SEQ ID NO: 10397 - protein, 635 aa, Artificial Sequence
  Description of Artificial Sequence: Synthetic polypeptide
  SS-CD19scFv-DmrA-Spacer-CD4TM protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGKMALIVLGGVAGLLLFIGLGIFF

SEQ ID NO: 10398 - protein, 417 aa, Artificial Sequence
  Description of Artificial Sequence: Synthetic polypeptide
  SS-CD19scFv-DmrA-CD52 GPI anchor protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRTSQTSSPSASSNISGGIFLFFVANAIIHLFCFS

SEQ ID NO: 10399 - protein, 740 aa, Artificial Sequence
  Description of Artificial Sequence: Synthetic polypeptide
  CD8ss-DmrC-CD8TM-41BB-CD3z-P2A-IgKss-CD19scFv-DmrA-CD4TM protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 10400 - protein, 739 aa, Artificial Sequence
  Description of Artificial Sequence: Synthetic polypeptide
  CD8ss-DmrC-CD8TM-41BB-CD3z-P2A-IgKss-CD19scFv-DmrA-CD4TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 10401 - protein, 762 aa, Artificial Sequence
  Description of Artificial Sequence: Synthetic polypeptide
  SS-DmrC-CD8TM-41BB-CD3z-P2A-SS-CD123scFv-DmrA-CD4TM protein
MRPTWAWWLFLVLLLALWAPARGGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGSGATNFSLLKQAGDVEENPGPSLWWRLWWLLLLLLLLWPMVWAPRADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGGGGSGGGGSGGGGSGGGGSEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 10402 - protein, 736 aa, Artificial Sequence
  Description of Artificial Sequence: Synthetic polypeptide
  CD8ss.DmrC.CD8TM.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 10403 - protein, 343 aa, Artificial Sequence
  Description of Artificial Sequence: Synthetic polypeptide
  CD8ss.DmrC.CD8hinge-TM.41BB.Zeta protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10404 - protein, 382 aa, Artificial Sequence
  Description of Artificial Sequence: Synthetic polypeptide
  hScnSS.CD19scFv.DmrA protein
MPLGLLWLGLALLGALHAQAGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEG

SEQ ID NO: 10405 - protein, 383 aa, Artificial Sequence
  Description of Artificial Sequence: Synthetic polypeptide
  hScnSS.CD20scFv.DmrA protein
MPLGLLWLGLALLGALHAQAGSEVQLQQSGAELVKPGASVKMSCKASGYTFTSYNMHWVKQTPGQGLEWIGAIYPGNGDTSYNQKFKGKATLTADKSSSTAYMQLSSLTSEDSADYYCARSNYYGSSYWFFDVWGAGTTVTVSSGSTSGGGSGGGSGGGGSSDIVLTQSPAILSASPGEKVTMTCRASSSVNYMDWYQKKPGSSPKPWIYATSNLASGVPARFSGSGSGTSYSLTISRVEAEDAATYYCQQWSFNPPTFGGGTKLEIKASGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEG

SEQ ID NO: 10406 - protein, 739 aa, Artificial Sequence
  Description of Artificial Sequence: Synthetic polypeptide
  CD8ss.FRB.CD8TM.41BB.Zeta.P2A.IgKss.CD19scFv.DmrA.CD4TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMALIVLGGVAGLLLFIGLGIFFCVRCRHRRRQ

SEQ ID NO: 10407 - protein, 736 aa, Artificial Sequence
  Description of Artificial Sequence: Synthetic polypeptide
  CD8ss.FRB.CD8TM.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 10408 - protein, 778 aa, Artificial Sequence
  Description of Artificial Sequence: Synthetic polypeptide
  CD8ss.FRB.CD8hinge-TM.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 10409 - protein, 740 aa, Artificial Sequence
  Description of Artificial Sequence: Synthetic polypeptide
  CD8ss.FRB.AMN.41BB.Zeta.P2A.IgKss.CD19scFv.DmrA.CD154TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASVWGSSAAGLAGGVAAAVLLALLVLLVAPPLLMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRMKIFMYLLTVFLITQMIGSALFAVYLHRR

SEQ ID NO: 10410 - protein, 735 aa, Artificial Sequence
  Description of Artificial Sequence: Synthetic polypeptide
  CD8ss.DmrC.CD8TM.41BB.Zeta.P2A.IgKss.CD19scFv.DmrA.CD71TM codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGRRCSGSICYGTIAVIVFFLIGFMIGYLGY

SEQ ID NO: 10411 - protein, 714 aa, Artificial Sequence
  Description of Artificial Sequence: Synthetic polypeptide
  CD8ss.DmrC.CD8TM.41BB.Zeta.P2A.CD71TM.DmrA.CD19scFv codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLLQAWDLYYHVFRRISKASAGTGSDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSRCSGSICYGTIAVIVFFLIGFMIGYLGYTGGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLEGGGGSPRDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 10412 - protein, 746 aa, Artificial Sequence
  Description of Artificial Sequence: Synthetic polypeptide
  CD8ss.FRB.CD8Hinge.CD8TM.41BB.Zeta.P2A.IgKss.CD19scFv.DmrA codon optimized protein
MALPVTALLLPLALLLHAARPGSILWHEMWHEGLEEASRLYFGERNVKGMFEVLEPLHAMMERGPQTLKETSFNQAYGRDLMEAQEWCRKYMKSGNVKDLTQAWDLYYHVFRRISKASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSGSGATNFSLLKQAGDVEENPGPSMETDTLLLWVLLLWVPGSTGDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPRGGGGSGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 10413 - protein, 1095 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSSASTGGGGSGGGGSGGGGSQSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVLGAASDAHKSEVAHRFKDLGEENFKALVLIAFAQYLQQSPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFQAETFTFHADICTLSEKERQIKKQTALVELVKHKPKATKEQLKAVMDDFAAFVEKCCKADDKETCFAEEGKKLVAASQAALGLAAALQVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSSGGGGSSGGGSGGGGSQSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 10414 - protein, 117 aa, Mus musculus
DVQLQESGPGLVKPSQSLSLTCSVTGYSITGGYLWNWIRQFPGNKLEWMGYISYDGTNNYKPSLKDRISITRDTSKNQFFLKLNSVTNEDTATYYCARYGRVFFDYWGQGTTLTVSS

SEQ ID NO: 10415 - protein, 447 aa, Artificial Sequence; identical to SEQ ID NO: 4931
  Description of Artificial Sequence: Synthetic polypeptide
  1-118: Variable regions with the CDRs of the heavy chain; 31-35: CDR1; 50-53: CDR3; 99-107: CDR3; 99-107: IgG1 hinge region; 296-297: Substitution within the IgG2 region

SEQ ID NO: 10416 - protein, 120 aa, Homo sapiens
  1-120; 2.9D10
EVQLVESGGGLVQPGGSLRLSCAASGFTFSSYWMSWVRQAPGKGLEWVANIKQDGGEQYYVDSVKGRFTISRDNAKNSLYLQMNSLRAEDTAVYYCARDWNYGYYDMDVWGQGTTVTVSS

SEQ ID NO: 10417 - protein, 121 aa, Homo sapiens
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 10418 - protein, 121 aa, Homo sapiens
  1-121; 3.18G1
EVQLLESGGDLVQPGGSLRLSCAASGFTFNSYAMSWVRQAPGKGLEWVSTISGSGGFTFSADSVKGRFTISRDNSKNTLFLQMNSLRVEDSAVYSCAKVLVGFNNGCWDYWGQGTLVTVSS

SEQ ID NO: 10419 - protein, 120 aa, Homo sapiens
  1-120; 2.7A4_opti
EVQLVESGGGLVKPGGSLRLSCAASGFTFSTYSMNWVRQAPGKGLEWVSSISSSGDYIYYADSVKGRFTISRDNAKNSLYLQMNSLRAEDTAVYYCARDLVTSMVAFDYWGQGTLVTVSS

SEQ ID NO: 10420 - protein, 471 aa, Artificial Sequence
  Description of Artificial Sequence: Synthetic polypeptide
MKCSWVMFLVATATGVNSQVQLQQPGAEIVRPGASVKLSCKASGYTFTDYWMNWVKLRPGQGLEWIGIIDPSDSYASYNQKFKGKATLTVDESSSTAYMQLSSLTSEDSAVYYCARKSYYGGNYYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 10421 - protein, 150 aa, Homo sapiens
LEMDMEFQAQLLFLLLLWLPDITGDIVLTQSPGTLSLSPGERATLSCRASQSVSSSYLAWYQQKPGQAPRLLIYGASTRATGMPDRFSGSGSGTDFTLTISRLEPEDFAVYYCQQYGSSPQTPQITFGGGTKVEIKRTVAAPSVFIFPPS

SEQ ID NO: 10422 - protein, 123 aa, Artificial Sequence; identical to SEQ ID NO: 6924
  Description of Artificial Sequence: Synthetic polypeptide

SEQ ID NO: 10423 - protein, 450 aa, Artificial Sequence
  Description of Artificial Sequence: Synthetic polypeptide
  Heavy chain T427 (wt IgG human gamma 1)
MQVQLQQPGTELVRPGASVKLSCKASGFSFTSYWMNWVKQRPGQGLEWIGMIHPSDSETRLNQKFKDRATLTVDKSSSTAYMQLSSPTSEDSAVYYCASEMDYYFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10424 - protein, 447 aa, Artificial Sequence
  Description of Artificial Sequence: Synthetic polypeptide
  Heavy chain T427 T366W:S354C (knob) coding sequence
MQVKLQESGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10425 - protein, 450 aa, Artificial Sequence
  Description of Artificial Sequence: Synthetic polypeptide
  Heavy chain T427 T366S:L368A:Y407V:Y349C (hole)
MQVQLQQPGTELVRPGASVKLSCKASGFSFTSYWMNWVKQRPGQGLEWIGMIHPSDSETRLNQKFKDRATLTVDKSSSTAYMQLSSPTSEDSAVYYCASEMDYYFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 10426 - protein, 800 aa, Artificial Sequence
  Description of Artificial Sequence: Synthetic polypeptide
  Heavy chain T427-PE38
QVQLQQPGTELVRPGASVKLSCKASGFSFTSYWMNWVKQRPGQGLEWIGMIHPSDSETRLNQKFKDRATLTVDKSSSTAYMQLSSPTSEDSAVYYCASEMDYYFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKASGGPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 10427 - protein, 450 aa, Artificial Sequence
  Description of Artificial Sequence: Synthetic polypeptide
  Heavy chain T427 T366W:S354C (knob) and A44C:C222A (Cys)
MQVQLQQPGTELVRPGASVKLSCKASGFSFTSYWMNWVKQRPGQCLEWIGMIHPSDSETRLNQKFKDRATLTVDKSSSTAYMQLSSPTSEDSAVYYCASEMDYYFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10428 - protein, 800 aa, Artificial Sequence
  Description of Artificial Sequence: Synthetic polypeptide
  Heavy chain T427-PE38 T366S:L368A:Y407V:Y349C (hole)
QVQLQQPGTELVRPGASVKLSCKASGFSFTSYWMNWVKQRPGQGLEWIGMIHPSDSETRLNQKFKDRATLTVDKSSSTAYMQLSSPTSEDSAVYYCASEMDYYFAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGKASGGPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 10429 - protein, 447 aa, Artificial Sequence
  Description of Artificial Sequence: Synthetic polypeptide
  Synthetic amino acid sequence of H1-heavy
EVQLVESGGGLVQPGGSLRLSCAASGFTFTDYYMSWVRQAPGKGLEWLGFIRNKANGYTTEYSASVKGRFTISRDNSKNSLYLQMNSLKTEDTAVYYCARDNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10430 - protein, 447 aa, Artificial Sequence
  Description of Artificial Sequence: Synthetic polypeptide
  Synthetic amino acid sequence of H3-heavy
EVQLVESGGGLVQPGGSLRLSCAASGFTFTDYYMSWVRQAPGKGLEWLGFIRNKANGYTTEYSASVKGRFTISRDNSKNSLYLQMNSLRAEDTAVYYCARDNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10431 - protein, 447 aa, Artificial Sequence
  Description of Artificial Sequence: Synthetic polypeptide
  Synthetic amino acid sequence of H4-heavy
EVQLVESGGGLVQPGGSLRLSCAASGFTFTDYYMSWVRQAPGKGLEWLGFIRNKANGYTTEYSASVKGRFTISRDNSKNTLYLQMNSLRAEDTAVYYCARDNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10432 - protein, 447 aa, Artificial Sequence; identical to SEQ ID NO: 10429
  Description of Artificial Sequence: Synthetic polypeptide
  amino acid sequence of H1-heavy

SEQ ID NO: 10433 - protein, 447 aa, Artificial Sequence; identical to SEQ ID NO: 10430
  Description of Artificial Sequence: Synthetic polypeptide
  amino acid sequence of H3-heavy

SEQ ID NO: 10434 - protein, 447 aa, Artificial Sequence; identical to SEQ ID NO: 10431
  Description of Artificial Sequence: Synthetic polypeptide
  amino acid sequence of H4-heavy

SEQ ID NO: 10435 - protein, 449 aa, Artificial Sequence; identical to SEQ ID NO: 5159
  Description of Artificial Sequence: Synthetic polypeptide

SEQ ID NO: 10436 - protein, 449 aa, Artificial Sequence; identical to SEQ ID NO: 5159
  Description of Artificial Sequence: Synthetic polypeptide

SEQ ID NO: 10437 - protein, 118 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSS

SEQ ID NO: 10438 - protein, 118 aa, Mus musculus
EVQLQQSGPELVKPGASMKISCKASGYSFTDYTLNWVKQSHGKTLEWIGLINPYNGGTTYNQKFKGKATLTVDKSSSTAYMELLSLTSEDSAVYYCAREEITKDFDFWGQGTTLTVSS

SEQ ID NO: 10439 - protein, 121 aa, Mus musculus
EVLLQQSGPELVKPGASVKIPCKASGYTFTDYNMDWVKQSHGMSLEWIGDINPNNGGTIFNQKFKGKATLTVDKSSSTAYMELRSLTSEDTAVYYCARGRYVGYYYAMDYWGQGTSVTVSS

SEQ ID NO: 10440 - protein, 118 aa, Mus musculus
QVQLQQSGAELAKPGASVKMSCKASGYTFTSYWMNWVKQRPGQGLEWIGYINPTTGSTDYNQKLKDKATLTADKSSNTAYMQLSSLTSEDSAVYYCAIGGYGSWFAYWGQGTLVTVSA

SEQ ID NO: 10441 - protein, 443 aa, Mus musculus
QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10442 - protein, 443 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10443 - protein, 446 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDCHCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10444 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVECKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10445 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPCSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10446 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKCCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10447 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCCKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10448 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDCTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10449 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKCHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10450 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHCCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10451 - protein, 446 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEKCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10452 - protein, 447 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDCHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10453 - protein, 447 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDCTHCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10454 - protein, 446 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPCSCKHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10455 - protein, 446 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPSCCTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10456 - protein, 446 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPSCDKHCCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10457 - protein, 444 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10458 - protein, 448 aa, Mus musculus
EVQLQQSGPELVKPGASVKISCKTSGYIFTAYTMHWVRQSLGESLDWIGGIKPNNGLANYNQKFKGKATLTVDKSSSTAYMDLRSLTSEDSAVYYCARSEITTEFDYWGQGTALTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10459 - protein, 123 aa, Homo sapiens
SIVMTQSPLSLPVSLGDQASISCRSSQSLENINGNTYKNWYFQKPGQSPQLLIYRVSNRVSGVLDRFSGSGSGTDFTLKITRVEAEDLGVYFCLQVTHVPWTFGGGTKLEIKRADAAPTKSIS

SEQ ID NO: 10460 - protein, 442 aa, Artificial Sequence
  Description of Artificial Sequence: Synthetic polypeptide
  Synthetic Heavy chain of anti-c-Met antibody LY2875358
QVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10461 - protein, 441 aa, Artificial Sequence
  Description of Artificial Sequence: Synthetic polypeptide
  synthetic construct
QVQLVQSGAEVKKPGSSVKVSCKASGYTFTSRYIHWVRQAPGQGLEWMGWIYPVTGDTYYNEKFKGRVTITADKSTSTAYMELSSLRSEDTAVYYCARGYGAFYYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10462 - protein, 441 aa, Artificial Sequence
  Description of Artificial Sequence: Synthetic polypeptide
  synthetic construct
QVQLVQSGAEVKKPGSSVKVSCKASGYTFTSRYIHWVRQAPGQGLEWMGWIYPVTGDTYYIEKFKGRVTITADKSTSTAYMELSSLRSEDTAVYYCARGYGAFFYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10463 - protein, 441 aa, Artificial Sequence
  Description of Artificial Sequence: Synthetic polypeptide
  synthetic construct
QVQLVQSGAEVKKPGSSVKVSCKASGYTFTSRYIHWVRQAPGQGLEWMGWIYPVTGDTYYREPFKGRVTITADKSTSTAYMELSSLRSEDTAVYYCARGYGAFYYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10464 - protein, 440 aa, Artificial Sequence
  Description of Artificial Sequence: Synthetic polypeptide
  synthetic construct
QVQLVQSGAEVKKPGASVKVSCKASGYTFTDYYMHWVRQAPGQGLEWMGRVNPNRGGTTYNQKFEGRVTMTTDTSTSTAYMELRSLRSDDTAVYYCARTNWLDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10465 - protein, 440 aa, Artificial Sequence
  Description of Artificial Sequence: Synthetic polypeptide
  synthetic construct
QVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10466 - protein, 440 aa, Artificial Sequence
  Description of Artificial Sequence: Synthetic polypeptide
  synthetic construct
QVQLVQSGAEVKKPGASVKVSCKASGYTFTDYYMHWVRQAPGQGLEWMGRVNPYRGSTTYNQKFEGRVTMTTDTSTSTAYMELRSLRSDDTAVYYCARANILDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 10467 - protein, 447 aa, Artificial Sequence; identical to SEQ ID NO: 10429
  Description of Artificial Sequence: Synthetic polypeptide
  synthetic; amino acid sequence of H1-heavy

SEQ ID NO: 10468 - protein, 447 aa, Artificial Sequence; identical to SEQ ID NO: 10430
  Description of Artificial Sequence: Synthetic polypeptide
  synthetic; amino acid sequence of H3-heavy

SEQ ID NO: 10469 - protein, 447 aa, Artificial Sequence; identical to SEQ ID NO: 10431
  Description of Artificial Sequence: Synthetic polypeptide
  synthetic; amino acid sequence of H4-heavy

SEQ ID NO: 10470 - protein, 118 aa, Mus musculus
EVKLVESGGGLVQPGGSLRLSCTTSGFTFTDYYMSWVRQSPGKALEWLTFIRNKANGYTTEYSASVKGRFTISRDNSQSILYLQMNTLRAEDSATYYCARDIPGFAYWGQGTLVTVSA

SEQ ID NO: 10471 - protein, 142 aa, Mus musculus
EVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSAKTTPPSVYPLAPGCGDTTGSS

SEQ ID NO: 10472 - protein, 467 aa, Mus musculus
MKLWLNWVFLVTLLNGFQCEVKLVESGGGLVQPGGSLRLSCTTSGFTFTDYYMSWVRQSPGKALEWLTFIRNKANGYTTEYSASVKGRFTISRDNSQSILYLQMNTLRAEDSATYYCARDIPGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10473 - protein, 469 aa, Mus musculus
MKMWLNWVFLVTLLNGIQCEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10474 - protein, 134 aa, Mus musculus
MRVLILLWLFTAFPGVLSDVQLQESGPSLVKPSQSLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 10475 - protein, 116 aa, Mus musculus
DVQLQESGPSLVKPSQSLSLTCTVTGYSITSDYAWNWIRQFPGNKLEWMGYISYSANTRYNPSLKSRISITRDTSKNQFFLQLNSVTTEDTATYYCATAGRGFPYWGQGTLVTVSA

SEQ ID NO: 10476 - protein, 116 aa, Mus musculus
DVQLQGSGPSLVKPSQSLSLTCTVTGYSITSDYAWNWIRQFPGNKLEWMGYISYSGNTRYNPSLRSRISITRDTSKNQFFLQLNSVTTEDTATYYCATAGRGFPYWGQGTLVTVSA

SEQ ID NO: 10477 - protein, 330 aa, Artificial Sequence
  Description of Artificial Sequence: Synthetic polypeptide
  Synthetic construct
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDECTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10478 - protein, 465 aa, Artificial Sequence
  Description of Artificial Sequence: Synthetic polypeptide
  Synthetic construct
MDWTWRILFLVAAATGVHSQVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDECTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10479 - protein, 449 aa, Homo sapiens
  MOD_RES (58)..(58): Asp or an amino acid having a side chain that is nonpolar and/or is charge neutral or positive and/or is not small
  MOD_RES (101)..(101): Tyr or an amino acid having a side chain that is nonpolar and/or a side chain that is non-neutral and/or a side chain that is not large
  MOD_RES (102)..(102): Tyr or an amino acid having a side chain that is nonpolar and/or a side chain that is non-neutral and/or a side chain that is not large
  MOD_RES (103)..(103): Asp or an amino acid having a side chain that is nonpolar and/or is charge neutral or positive and/or is not small
  MOD_RES (105)..(105): Glu or an amino acid having a side chain that is nonpolar and/or is charge neutral or positive and/or is not small
QVQLKQSGPGLVQPSQSLSITCTVSGFSLTNYGVHWVRQSPGKGLEWLGVIWSGGNTXYNTPFTSRLSINKDNSKSQVFFKMNSLQSNDTAIYYCARALTXXXYXFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10480 - protein, 468 aa, Homo sapiens
MDWTWRILFLVAAATGTHAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTAYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10481 - protein, 468 aa, Homo sapiens
MDWTWRILFLVAAATGTHAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYADYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10482 - protein, 468 aa, Homo sapiens
MDWTWRILFLVAAATGTHAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYNYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10483 - protein, 468 aa, Homo sapiens
MDWTWRILFLVAAATGTHAQVQLKQSGPGLVQPSQSLSITCTVSGFSLTNYGVHWVRQSPGKGLEWLGVIWSGGNTNYNTPFTSRLSINKDNSKSQVFFKMNSLQSNDTAIYYCARALTYYNYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10484 - protein, 468 aa, Homo sapiens
MDWTWRILFLVAAATGTHAQVQLKQSGPGLVQPSQSLSITCTVSGFSLTNYGVHWVRQSPGKGLEWLGVIWSGGNTNYNTPFTSRLSINKDNSKSQVFFKMNSLQSNDTAIYYCARALTYYNYQFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10485 - protein, 142 aa, Artificial Sequence
  Description of Artificial Sequence: Synthetic polypeptide
MGFGLSWLFLVAILKGVQCQVQLVQSGAEVKKPGASVKVSCKASGYTFTSYGINWVRQAPGQGLEWMGWISAYNGNTNYAQKLQGRVTMTTDTSTSTAYMELRSLRSDDTAVYYCARDSGGYGSGSVPFDPWGQGTLVTVSS

SEQ ID NO: 10486 - protein, 142 aa, Artificial Sequence
  Description of Artificial Sequence: Synthetic polypeptide
MGFGLSWLFLVAILKGVQCQVQLVQSGAEVKKPGASVKVSCKASGYTFTSYGINWVRQAPGQGLEWMGWISAYNGNTNYAQKLQGRVTMTTDTSTSTAYMELRSLRSDDTAVYYCARDLGGYGSGSVPFDPWGQGTLVTVSS

SEQ ID NO: 10487 - protein, 142 aa, Artificial Sequence
  Description of Artificial Sequence: Synthetic polypeptide
MGFGLSWLFLVAILKGVQCQVQLVQSGAEVKKPGASVKVSCKASGYTFTSYGINWVRQAPGQGLEWMGWISAYNGNTNYAQKLQGRVTMTTDTSTSTAYMELRSLRSDDTAVYYCARDGGPYGFGPPWFDPWGQGTLVTVSS

SEQ ID NO: 10488 - protein, 143 aa, Artificial Sequence
  Description of Artificial Sequence: Synthetic polypeptide
MGFGLSWLFLVAILKGVQCQVQLVQSGAEVKKPGASVKVSCKASGYTFTSYGISWVRQAPGQGLEWMGWISAYNGNTDYAQKLQGRVTMTTDTSTSTAYMELRSLRSDDTAVYYCARDLGGYGSGGVGYFDPWGRGTSVTVSS

SEQ ID NO: 10489 - protein, 143 aa, Artificial Sequence
  Description of Artificial Sequence: Synthetic polypeptide
MGFGLSWLFLVAILKGVQCQVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLGGYGSGGVGYFDPWGRGTLVTVSS

SEQ ID NO: 10490 - protein, 138 aa, Artificial Sequence
  Description of Artificial Sequence: Synthetic polypeptide
MGFGLSWLFLVAILKGVQCQVQLVQSGAEVKKPGSSVKVSCKASGGTFGSYAISWVRQAPGQGLEWMGSIIPIFGTANYAQKFQGRVTITADESTSTAYMELSSLRSEDTAVYYCARMGRGKVAFDIWGQGTMVTASS

SEQ ID NO: 10491 - protein, 138 aa, Artificial Sequence
  Description of Artificial Sequence: Synthetic polypeptide
MGFGLSWLFLVAILKGVQCQVQLVQSGAEVKKPGSSVKVSCKASGGTFGSYAISWVRQAPGQGLEWMGSIIPIFGTANYAQKFQGRVTITADESTSTAYMELSSLRSEDTAVYYCARMARGKVAFDIWGQGTMVTVSS

SEQ ID NO: 10492 - protein, 138 aa, Artificial Sequence
  Description of Artificial Sequence: Synthetic polypeptide
MGFGLSWLFLVAILKGVQCQVQLVQSGAEVKKPGSSVKVSCKASGGTFSSYAISWVRQAPGQGLEWMGSIIPIFGTANYAQKFQGRVTITADESTSTAYMELSSLRSEDTAVYYCARMVRGKVAFDIWGQGTMVTVSS

SEQ ID NO: 10493 - protein, 140 aa, Artificial Sequence
  Description of Artificial Sequence: Synthetic polypeptide
MGFGLSWLFLVAILKGVQCQVQLVQSGAEVKKPGSSVKVSCKASGGTFSSYAISWVRQAPGQGLEWMGSIIPIFGTANYAQKFQGRVTITADESTSTAYMELSSLRSEDTAVYYCARDPSVDLYWYFDLWGRGTLVTVSS

SEQ ID NO: 10494 - protein, 138 aa, Artificial Sequence
  Description of Artificial Sequence: Synthetic polypeptide
MGFGLSWLFLVAILKGVQCQVQLQESGPGLVKPSETLSLTCTVSGGSVNSGSYYWSWVRQPPGKGLWIGSIYYSGSTNYNPSLKSRVTISVDTSKNQFSLKLSSVTAADTAVYYCARDSPYYGYFDYWGQGTLVTVSS

SEQ ID NO: 10495 - protein, 139 aa, Artificial Sequence
  Description of Artificial Sequence: Synthetic polypeptide
MGFGLSWLFLVAILKGVQCQVQLQESGPGLVKPSETLSLTCTVSGGSVSSGSYYWSWIRQPPGKGLWIGRIYYSGSTNYNPSLKSRVTISVDTSKNQFSLKLSSVTAADTAVYYCAREPLYDSSGFQHWGQGTLVTVSS

SEQ ID NO: 10496 - protein, 118 aa, Artificial Sequence
  Description of Artificial Sequence: Synthetic polypeptide
LVTLKVCGPGILQPSQTLSLTCSFSGFSLSTSGMGVGWLRQPSGKSLEWLAHIWWDDDKRYNPALKSRLTISKDTSSNQVFLKIASVDTTDTATYYCARMGMTGYFDFWGQGTTLTVS

SEQ ID NO: 10497 - protein, 452 aa, Artificial Sequence; identical to SEQ ID NO: 7318
  Description of Artificial Sequence: Synthetic polypeptide
  Cetuximab A119 R216 Ins222PKS heavy chain

SEQ ID NO: 10498 - protein, 449 aa, Artificial Sequence
  Description of Artificial Sequence: Synthetic polypeptide
  Cetuximab S119 K216 heavy chain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10499 - protein, 449 aa, Artificial Sequence
  Description of Artificial Sequence: Synthetic polypeptide
  Cetuximab A119 R216 E358 M360 heavy chain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10500 - protein, 449 aa, Artificial Sequence
  Description of Artificial Sequence: Synthetic polypeptide
  DP-h3, 7 heavy chain nucleic acid S119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10501 - protein, 449 aa, Artificial Sequence
  Description of Artificial Sequence: Synthetic polypeptide
  DP-h3, 7 heavy chain amino acid S119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10502 - protein, 449 aa, Artificial Sequence
  Description of Artificial Sequence: Synthetic polypeptide
  D-h3, 7 heavy chain amino acid S119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10503 - protein, 449 aa, Artificial Sequence
  Description of Artificial Sequence: Synthetic polypeptide
  -h3, 7 heavy chain amino acid S119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10504 - protein, 449 aa, Artificial Sequence
  Description of Artificial Sequence: Synthetic polypeptide
  FDP-h3, 7, 11, 15 heavy chain amino acid S119
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10505 - protein, 449 aa, Artificial Sequence
  Description of Artificial Sequence: Synthetic polypeptide
  HC-Y104D control heavy chain amino acid S119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10506 - protein, 449 aa, Artificial Sequence
  Description of Artificial Sequence: Synthetic polypeptide
  HC-Y104E heavy chain amino acid S119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10507 - protein, 449 aa, Artificial Sequence
  Description of Artificial Sequence: Synthetic polypeptide
  HC-Y104E/HC-Q111P heavy chain amino acid S119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10508 - protein, 449 aa, Artificial Sequence
  Description of Artificial Sequence: Synthetic polypeptide
  HC-S25C/HC-Y104E heavy chain amino acid S119
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10509 - protein, 449 aa, Artificial Sequence
  Description of Artificial Sequence: Synthetic polypeptide
  HC-S53G/HC-Y104E heavy chain amino acid S119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10510 - protein, 449 aa, Artificial Sequence
  Description of Artificial Sequence: Synthetic polypeptide
  HC-S53G/HC-Y104E/HC-Q111P heavy chain amino acid S119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10511 - protein, 449 aa, Artificial Sequence
  Description of Artificial Sequence: Synthetic polypeptide
  HC-S25V/HC-Y104E heavy chain amino acid S119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10512 - protein, 449 aa, Artificial Sequence
  Description of Artificial Sequence: Synthetic polypeptide
  HC-S25V/HC-Y104E/HC-Q111P heavy chain amino acid S119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10513 - protein, 449 aa, Artificial Sequence
  Description of Artificial Sequence: Synthetic polypeptide
  HC-S25V/HC-S53G/HC-Y104E heavy chain amino acid S119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10514 - protein, 449 aa, Artificial Sequence
  Description of Artificial Sequence: Synthetic polypeptide
  HC-S25V/HC-S53G/HC-Y104E/HC-Q111P heavy chain amino acid S119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10515 - protein, 119 aa, Artificial Sequence
  Description of Artificial Sequence: Synthetic polypeptide
  HC-S25V/HC-S53G/HC-Y104E/HC-Q111P heavy chain variable domain amino acid S119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 10516 - protein, 119 aa, Artificial Sequence
  Description of Artificial Sequence: Synthetic polypeptide
  HC-S25V/HC-S53G/HC-Y104E/HC-Q111P heavy chain variable domain amino acid A119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 10517 - protein, 449 aa, Artificial Sequence
  Description of Artificial Sequence: Synthetic polypeptide
  HC-T30F/HC-Y104E heavy chain amino acid S119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10518 - protein, 449 aa, Artificial Sequence
  Description of Artificial Sequence: Synthetic polypeptide
  HC-T30F/HC-Y104E/HC-Q111P heavy chain amino acid S119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10519 - protein, 449 aa, Artificial Sequence
  Description of Artificial Sequence: Synthetic polypeptide
  HC-T30F/HC-S53G/HC-Y104E heavy chain amino acid S119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10520 - protein, 449 aa, Artificial Sequence
  Description of Artificial Sequence: Synthetic polypeptide
  HC-T30F/HC-S53G/HC-Y104E/HC-Q111P heavy chain amino acid S119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10521 - protein, 119 aa, Artificial Sequence
  Description of Artificial Sequence: Synthetic polypeptide
  HC-T30F/HC-S53G/HC-Y104E/HC-Q111P heavy chain variable domain amino acid S119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 10522 - protein, 119 aa, Artificial Sequence
  Description of Artificial Sequence: Synthetic polypeptide
  HC-T30F/HC-S53G/HC-Y104E/HC-Q111P heavy chain variable domain amino acid A119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 10523 - protein, 449 aa, Artificial Sequence
  Description of Artificial Sequence: Synthetic polypeptide
  HC-D72L/HC-Y104E heavy chain amino acid S119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10524 - protein, 449 aa, Artificial Sequence
  Description of Artificial Sequence: Synthetic polypeptide
  HC-D72L/HC-Y104E/HC-Q111P heavy chain amino acid S119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10525 - protein, 449 aa, Artificial Sequence
  Description of Artificial Sequence: Synthetic polypeptide
  HC-S53G/HC-D72L/HC-Y104E heavy chain amino acid S119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10526 - protein, 449 aa, Artificial Sequence
  Description of Artificial Sequence: Synthetic polypeptide
  HC-S53G/HC-D72L/HC-Y104E/HC-Q111P heavy chain amino acid S119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10527 - protein, 119 aa, Artificial Sequence
  Description of Artificial Sequence: Synthetic polypeptide
  HC-S53G/HC-D72L/HC-Y104E/HC-Q111P heavy chain variable domain amino acid S119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGPGTLVTVSS

SEQ ID NO: 10528 - protein, 119 aa, Artificial Sequence
  Description of Artificial Sequence: Synthetic polypeptide
  HC-S53G/HC-D72L/HC-Y104E/HC-Q111P heavy chain variable domain amino acid A119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGPGTLVTVSA

SEQ ID NO: 10529 - protein, 449 aa, Artificial Sequence
  Description of Artificial Sequence: Synthetic polypeptide
  EP-h1, 2, 4, 5, 6, 8 heavy chain amino acid S119
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10530 - protein, 449 aa, Artificial Sequence
  Description of Artificial Sequence: Synthetic polypeptide
  EP-h3, 7 heavy chain amino acid S119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10531 - protein, 449 aa, Artificial Sequence
  Description of Artificial Sequence: Synthetic polypeptide
  EP-h9, 12, 14 heavy chain amino acid S119
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10532 - protein, 449 aa, Artificial Sequence
  Description of Artificial Sequence: Synthetic polypeptide
  EP-h10, 13 heavy chain amino acid S119
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10533 - protein, 449 aa, Artificial Sequence
  Description of Artificial Sequence: Synthetic polypeptide
  FEP-h1, 19, 20, 21 heavy chain amino acid S119
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10534 - protein, 449 aa, Artificial Sequence
  Description of Artificial Sequence: Synthetic polypeptide
  FEP-h2 heavy chain amino acid S119
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10535 - protein, 449 aa, Artificial Sequence
  Description of Artificial Sequence: Synthetic polypeptide
  FEP-h3, 7, 11, 15 heavy chain amino acid S119
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10536 - protein, 449 aa, Artificial Sequence
  Description of Artificial Sequence: Synthetic polypeptide
  FEP-h4, 8, 12, 16 heavy chain amino acid S119
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10537 - protein, 449 aa, Artificial Sequence; identical to SEQ ID NO: 10533
  Description of Artificial Sequence: Synthetic polypeptide
  FEP-h5, 9, 13, 17 heavy chain amino acid S119

SEQ ID NO: 10538 - protein, 448 aa, Artificial Sequence
  Description of Artificial Sequence: Synthetic polypeptide
  FEP-h6 heavy chain amino acid S119
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10539 - protein, 449 aa, Artificial Sequence
  Description of Artificial Sequence: Synthetic polypeptide
  FEP-h10, 14, 18 heavy chain amino acid S119
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10540 - protein, 449 aa, Artificial Sequence
  Description of Artificial Sequence: Synthetic polypeptide
  HC-F27G/HC-Y104E heavy chain amino acid S119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10541 - protein, 449 aa, Artificial Sequence
  Description of Artificial Sequence: Synthetic polypeptide
  HC-F27G/HC-Y104E/HC-Q111P heavy chain amino acid S119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10542 - protein, 449 aa, Artificial Sequence
  Description of Artificial Sequence: Synthetic polypeptide
  HC-F27G/HC-S53G/HC-Y104E heavy chain amino acid S119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10543 - protein, 449 aa, Artificial Sequence
  Description of Artificial Sequence: Synthetic polypeptide
  HC-F27G/HC-S53G/HC-Y104E/HC-Q111P heavy chain amino acid S119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10544 - protein, 119 aa, Artificial Sequence
  Description of Artificial Sequence: Synthetic polypeptide
  HC-F27G/HC-S53G/HC-Y104E/HC-Q111P heavy chain variable domain amino acid S119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 10545 - protein, 119 aa, Artificial Sequence
  Description of Artificial Sequence: Synthetic polypeptide
  HC-F27G/HC-S53G/HC-Y104E/HC-Q111P heavy chain variable domain amino acid A119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 10546 - protein, 449 aa, Artificial Sequence
  Description of Artificial Sequence: Synthetic polypeptide
  HC-S25C/HC-Y104D heavy chain amino acid S119
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10547 - protein, 449 aa, Artificial Sequence
  Description of Artificial Sequence: Synthetic polypeptide
  HC-S53G/HC-Y104D heavy chain amino acid S119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10548 - protein, 449 aa, Artificial Sequence
  Description of Artificial Sequence: Synthetic polypeptide
  HC-S53G/HC-Y104D/HC-Q111P heavy chain amino acid S119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10549 - protein, 449 aa, Artificial Sequence
  Description of Artificial Sequence: Synthetic polypeptide
  HC-S25V/HC-Y104D heavy chain amino acid S119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10550 - protein, 449 aa, Artificial Sequence
  Description of Artificial Sequence: Synthetic polypeptide
  HC-S25V/HC-Y104D/HC-Q111P heavy chain amino acid S119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10551 - protein, 449 aa, Artificial Sequence
  Description of Artificial Sequence: Synthetic polypeptide
  HC-S25V/HC-S53G/HC-Y104D heavy chain amino acid S119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10552 - protein, 449 aa, Artificial Sequence
  Description of Artificial Sequence: Synthetic polypeptide
  HC-S25V/HC-S53G/HC-Y104D/HC-Q111P heavy chain amino acid S119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10553 - protein, 449 aa, Artificial Sequence
  Description of Artificial Sequence: Synthetic polypeptide
  HC-T30F/HC-Y104D heavy chain amino acid S119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10554 - protein, 449 aa, Artificial Sequence
  Description of Artificial Sequence: Synthetic polypeptide
  HC-T30F/HC-Y104D/HC-Q111P heavy chain amino acid S119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10555 - protein, 449 aa, Artificial Sequence
  Description of Artificial Sequence: Synthetic polypeptide
  HC-T30F/HC-S53G/HC-Y104D heavy chain amino acid S119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10556 - protein, 449 aa, Artificial Sequence
  Description of Artificial Sequence: Synthetic polypeptide
  HC-T30F/HC-S53G/HC-Y104D/HC-Q111P heavy chain amino acid S119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10557 - protein, 449 aa, Artificial Sequence
  Description of Artificial Sequence: Synthetic polypeptide
  HC-D72L/HC-Y104D heavy chain amino acid S119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10558 - protein, 449 aa, Artificial Sequence
  Description of Artificial Sequence: Synthetic polypeptide
  HC-D72L/HC-Y104D/HC-Q111P heavy chain amino acid S119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10559 - protein, 449 aa, Artificial Sequence
  Description of Artificial Sequence: Synthetic polypeptide
  HC-S53G/HC-D72L/HC-Y104D heavy chain amino acid S119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10560 - protein, 449 aa, Artificial Sequence
  Description of Artificial Sequence: Synthetic polypeptide
  HC-S53G/HC-D72L/HC-Y104D/HC-Q111P heavy chain amino acid S119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10561 - protein, 449 aa, Artificial Sequence
  Description of Artificial Sequence: Synthetic polypeptide
  HC-F27G/HC-Y104D heavy chain amino acid S119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10562 - protein, 449 aa, Artificial Sequence
  Description of Artificial Sequence: Synthetic polypeptide
  HC-F27G/HC-Y104D/HC-Q111P heavy chain amino acid S119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10563 - protein, 449 aa, Artificial Sequence
  Description of Artificial Sequence: Synthetic polypeptide
  HC-F27G/HC-S53G/HC-Y104D heavy chain amino acid S119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10564 - protein, 449 aa, Artificial Sequence
  Description of Artificial Sequence: Synthetic polypeptide
  HC-F27G/HC-S53G/HC-Y104D/HC-Q111P heavy chain amino acid S119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10565 - protein, 449 aa, Artificial Sequence
  Description of Artificial Sequence: Synthetic polypeptide
  DP-h1, 2, 4, 5, 6, 8 heavy chain amino acid S119
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10566 - protein, 449 aa, Artificial Sequence
  Description of Artificial Sequence: Synthetic polypeptide
  DP-h9, 12, 14 heavy chain amino acid S119
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10567 - protein, 449 aa, Artificial Sequence
  Description of Artificial Sequence: Synthetic polypeptide
  DP-h10, 13 heavy chain amino acid S119
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10568 - protein, 449 aa, Artificial Sequence
  Description of Artificial Sequence: Synthetic polypeptide
  FDP-h1, 19, 20, 21 heavy chain amino acid S119
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10569 - protein, 449 aa, Artificial Sequence
  Description of Artificial Sequence: Synthetic polypeptide
  FDP-h2 heavy chain amino acid S119
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10570 - protein, 449 aa, Artificial Sequence
  Description of Artificial Sequence: Synthetic polypeptide
  FDP-h4, 8, 12, 16 heavy chain amino acid S119
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10571 - protein, 449 aa, Artificial Sequence; identical to SEQ ID NO: 10568
  Description of Artificial Sequence: Synthetic polypeptide
  FDP-h5, 9, 13, 17 heavy chain amino acid S119

SEQ ID NO: 10572 - protein, 449 aa, Artificial Sequence
  Description of Artificial Sequence: Synthetic polypeptide
  FDP-h6 heavy chain amino acid S119
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10573 - protein, 449 aa, Artificial Sequence
  Description of Artificial Sequence: Synthetic polypeptide
  FDP-h10, 14, 18 heavy chain amino acid S119
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDDEFAYWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10574 - protein, 449 aa, Artificial Sequence
  Description of Artificial Sequence: Synthetic polypeptide
  C225v5 Activatable Antibody Heavy Chain
QVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10575 - protein, 449 aa, Artificial Sequence
  Description of Artificial Sequence: Synthetic polypeptide
  C225v4 Activatable Antibody Heavy Chain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10576 - protein, 449 aa, Artificial Sequence
  Description of Artificial Sequence: Synthetic polypeptide
  C225v6 Activatable Antibody Heavy Chain
QVQLKQSGPGLVQPSQSLSITCTVSGFSLTNYGVHWVRQSPGKGLEWLGVIWSGGNTDYNTPFTSRLSINKDNSKSQVFFKMNSLQSQDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10577 - protein, 118 aa, Mus sp.
EVQLVESGGGLVQPGGSLRLSCAASGFTFSSYAMSWVRQAPGKGLEWVSAITGTGGETYYADSVKGRFTISRDNSKNTLYLQMNSLRAEDTAVYYCARGWSWTGVDPWGQGTLVTVSS

SEQ ID NO: 10578 - protein, 470 aa, Artificial Sequence
  Description of Artificial Sequence: Synthetic polypeptide
MRVLILLWLFTAFPGILSDVQLQESGPGLVKPSQSLSLTCTVTGYSITSDYAWNWIRLFPGNKLEWMGFINYSGNTSYNPSLKSRISITRDTSKNQFFLKLNSLTTDDTATYYCARGGLSRFPYWGQGTLVTVSAAKTTAPSVYPLAPVCGGTTGSSVTLGCLVKGYFPEPVTLTWNSGSLSSGVHTFPALLQSGLYTLSSSVTVTSNTWPSQTITCNVAHPASSTKVDKKIEPRVPITQNPCPPLKECPPCAAPDLLGGPSVFIFPPKIKDVLMISLSPMVTCVVVDVSEDDPDVQISWFVNNVEVHTAQTQTHREDYNSTLRVVSALPIQHQDWMSGKEFKCKVNNRALPSPIEKTISKPRGPVRAPQVYVLPPPAEEMTKKEFSLTCMITGFLPAEIAVDWTSNGRTEQNYKNTATVLDSDGSYFMYSKLRVQKSTWERGSLFACSVVHEGLHNHLTTKTISRSLGK

SEQ ID NO: 10579 - protein, 475 aa, Artificial Sequence
  Description of Artificial Sequence: Synthetic polypeptide
VSRAATMDWTWRVFCLLAVAPGAHSQVKLLEQSGAEVKKPGASVKVSCKASGFSLTNYGVHWVRQAPGQRLEWMGVIWSGGNTDYNTPFTSRVTITRDTSATTAYMGLSSLRPEDTAVYYCARALTYYDYEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10580 - protein, 448 aa, Artificial Sequence
  Description of Artificial Sequence: Synthetic polypeptide
  huEGFR-7 HC
QVQLVQSGAEVAKPGASVKLSCKASGYTFTSYWMQWVKQRPGQGLECIGTIYPGDGDTTYTQKFQGKATLTADKSSSTAYMQLSSLRSEDSAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10581 - protein, 448 aa, Artificial Sequence
  Description of Artificial Sequence: Synthetic polypeptide
  huEGFR-7 HC CDR grafted
QVQLVQSGAEVKKPGASVKVSCKASGYTFTSYWMQWVRQAPGQGLEWMGTIYPGDGDTTYTQKFKGRVTMTRDTSTSTVYMELSSLRSEDTAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10582 - protein, 214 aa, Artificial Sequence
  Description of Artificial Sequence: Synthetic polypeptide
  huEGFR-7 LCv1.0
DIQMTQSPSSLSASVGDRVTITCRASQDINNYLAWYQHKPGKGPKLLIHYTSTLHPGIPSRFSGSGSGRDYSFSISSLEPEDIATYYCLQYDNLLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10583 - protein, 214 aa, Artificial Sequence
  Description of Artificial Sequence: Synthetic polypeptide
  huEGFR-7 LCv1.01
DIQMTQSPSSLSASVGDRVTITCKASQDINNYLAWYQHKPGKGPKLLIHYTSTLHPGIPSRFSGSGSGRDYSFSISSLEPEDIATYYCLQYDNLLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10584 - protein, 214 aa, Artificial Sequence
  Description of Artificial Sequence: Synthetic polypeptide
  huEGFR-7 LC_CDR grafted
DIQMTQSPSSLSASVGDRVTITCRASQDINNYLAWYQQKPGKAPKLLIYYTSTLHPGVPSRFSGSGSGTDFTFTISSLQPEDIATYYCLQYDNLLYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10585 - protein, 445 aa, Artificial Sequence
  Description of Artificial Sequence: Synthetic polypeptide
  huEGFR-12 HC
QVQLVQSGAEVAKPGASVKLSCKASGYTFTSYWMQWVKQRPGQGLECIGTIYPGDGDTRYIQKFQGKATLTADKSSSTAYMQLSSLRSEDSAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSL

SEQ ID NO: 10586 - protein, 214 aa, Artificial Sequence
  Description of Artificial Sequence: Synthetic polypeptide
  huEGFR-12 HC
DVQITQSPSSLAASVGERITINCRASQSISRYLAWYQEKPGKTNKLLIYSGSTLQSGIPSRFSGSGSGTDFTLTISSLEPEDFAMYYCQQHNEYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10587 - protein, 214 aa, Artificial Sequence
  Description of Artificial Sequence: Synthetic polypeptide
  huEGFR-12 LCv.1.01
DVQITQSPSSLAASVGERITINCRASKSISKYLAWYQEKPGKTNKLLIYSGSTLQSGIPSRFSGSGSGTDFTLTISSLEPEDFAMYYCQQHNEYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10588 - protein, 448 aa, Artificial Sequence
  Description of Artificial Sequence: Synthetic polypeptide
  huEGFR-6 HCv1.0
QVQLVQSGAEVAKPGASVKLSCKASGYTFTSYWMQWVKQRPGQGLECIGALYPGDGDARYTQKFQGKATLTADTSSSTAYMQLSSLRSEDSAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10589 - protein, 448 aa, Artificial Sequence
  Description of Artificial Sequence: Synthetic polypeptide
  huEGFR-6 HCv1.11
QVQLVQSGAEVAKPGASVKLSCKASGYTFTSYWMQWVKQRPGQGLEWIGALYPGDGDARYTQKFQGKATLTADTSSSTAYMQLSSLRSEDSAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10590 - protein, 448 aa, Artificial Sequence
  Description of Artificial Sequence: Synthetic polypeptide
  huEGFR-7 HCv1.11
QVQLVQSGAEVAKPGASVKLSCKASGYTFTSYWMQWVKQRPGQGLEWIGTIYPGDGDTTYTQKFQGKATLTADKSSSTAYMQLSSLRSEDSAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10591 - protein, 119 aa, Artificial Sequence
  Description of Artificial Sequence: Synthetic polypeptide
  muEGFR5HC
QVQLQQSGAELARPGASVKLSCKASGYTFTSYWMQWVKQRPGQGLECIGTIYPGDGDTRYTQKFKGKATLTADKSSSTAYMQLSSLASEDSAVYYCARYDAPGYTMDYWGQGTSVTVSS

SEQ ID NO: 10592 - protein, 119 aa, Artificial Sequence
  Description of Artificial Sequence: Synthetic polypeptide
  muEGFR9HC and muEGFR17HC
QVQLQQSGAELARPGASVKLSCKASGYTFTSYWMQWVKQRPGQGLECIGTIYPGDGDTRYTQKFKGKATLTADKSSSTAYMQLSSLASEDSAVYYCARYDAPGYAMDYWGQGTSVTVSS

SEQ ID NO: 10593 - protein, 119 aa, Artificial Sequence
  Description of Artificial Sequence: Synthetic polypeptide
  muEGFR13HC
QVQLQQSGAELARPGASVKLSCKASGYTFTSYWMQWVKQRPGQGLECIGTIYPGDGDTTYTQKFKGKATLTADKSSSTAYMQLNSLASEDSAVYYCARYDAPGYAMDYWGQGTSVTVSS

SEQ ID NO: 10594 - protein, 129 aa, Artificial Sequence
  Description of Artificial Sequence: Synthetic polypeptide
  synthetic antibody sequence
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSS

SEQ ID NO: 10595 - protein, 129 aa, Artificial Sequence
  Description of Artificial Sequence: Synthetic polypeptide
  synthetic antibody sequence
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVAYCSSSNCAKWPEYFQHWGQGTLVTVSS

SEQ ID NO: 10596 - protein, 129 aa, Artificial Sequence
  Description of Artificial Sequence: Synthetic polypeptide
  synthetic antibody sequence
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSS

SEQ ID NO: 10597 - protein, 129 aa, Artificial Sequence
  Description of Artificial Sequence: Synthetic polypeptide
  synthetic antibody sequence
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 10598 - protein, 170 aa, Homo sapiens
QVQLVESGGGVVQPGRSLRLSCAASGFTFSSYGMHWVRQAPGKGLEWVAVIWYDGSNKYYVDSVKGRFTISRDNSKNTLYLQMNSLRAEDTAVYYCARDGWQQLAPFDYWGQGTLVTVSSASTKGPSVFPLAPSSKSTSGGTAALGCLVKDYFPEPVTVSWNSGALTSGV

SEQ ID NO: 10599 - protein, 124 aa, Homo sapiens
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 10600 - protein, 118 aa, Homo sapiens
QVQLQQSGPGLVKPSQTLSLTCAISGDSVSSNNAAWNWIRQSPARGLEWLGRTYYRSKWYNDYVVSVKSRITINPDTSKNQFSLQLNSVTPEDTAVYYCVRATAFDYWGQGTLVTVSS

SEQ ID NO: 10601 - protein, 118 aa, Homo sapiens
QVQLQQSGPGLVKPSQTLSLTCAISGDSVSSYSSAWNWIRQSPSRGLEWLGRAYHRSRWYYEYAVSVKSRINITPDTSKNQFSLQLNSVTPEDTAVYYCARGSRFDYWGQGTLVTVSS

SEQ ID NO: 10602 - protein, 126 aa, Homo sapiens
QVQLQESGPFLVKPSQTLSLTCTVSGGSISSGGYYWSWIRQHPGKGLEWIGFIYYRGNTYYNPSLKSRVTISVDTSKNQFSLKLSSVTAADTAVYYCARDGYCSRTGCYGGWFDPWGQGTLVTVSP

SEQ ID NO: 10603 - protein, 116 aa, Homo sapiens
EGQLLESGGGWVQPGESLRLSCAASGFTFSSYAMSWVRQAPGKGLEWVSAISGSGGSTNYADSVKGRFTISRDNSKNTLYLQVNSLRVEDTAVYYCAGSSGWSEYWGQGTLVTVSS

SEQ ID NO: 10604 - protein, 116 aa, Homo sapiens
EVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSS

SEQ ID NO: 10605 - protein, 128 aa, Homo sapiens
QVQLVESGGGVVQPGRSLRLSCVASGFTLSSYGMHWVRQAPGKGLEWVAVTSYDGSKKDYADSAKGRFTISRDNSKNTLYLQMNSLRAEDTAVYYCVSEGYCSSSSCYKYYYYGMDVWGQGTTVTVSS

SEQ ID NO: 10606 - protein, 128 aa, Homo sapiens
QVQLVESGGGVVQPGRSLRLSCAASGFTLSSYGMHWVRQAPGKGLEWVAVMSYDGSKEDYADSVKGRFTISRDNSENTLYLQMNSLRAEDTAVYYCVSEGYCSSRSCYKYYYYGMDVWGQGTTVTVSS

SEQ ID NO: 10607 - protein, 128 aa, Homo sapiens
QVQLVESGGGVVQPGRSLRLSCVASGFTLSSYGMHWVRQAPGKGLEWVAVTSYDGSKKDYADSVKGRFTISRDNSKNTLYLQMNSLRAEDTAVYYCVSEGYCDSSSCYKYYYYGMDVWGQGTTVTVSS

SEQ ID NO: 10608 - protein, 128 aa, Homo sapiens
QVQLVESGGGVVQPGRSLRLSCVASGFTLSSYGMHWVRQAPGKGLEWVAVTSYDGSKKDYADSVKGRFTISRDNSKNTLYLQMNSLRAEDTAVYYCVSEGYCDSTSCYKYYYYGMDVWGQGTTVTVSS

SEQ ID NO: 10609 - protein, 128 aa, Homo sapiens
QVQLVESGGGVVQPGRSLRLSCVASGFTLSSYGMHWVRQALGKGLEWVAVTSYDGSKKDYADSVKGRFTISRDNSKNTLYLQMNSLRAEDTAVYYCVSEGYCDSTSCYKYYYYGMDVWGQGTTVTVSS

SEQ ID NO: 10610 - protein, 110 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARWGQGTLVTVSSA

SEQ ID NO: 10611 - protein, 121 aa, Homo sapiens
QVQLVESGGGVVQPGRSLRLSCAASGFTFSSYGMHWVRQAPGKGLEWVAVIWYDGSNKYYVDSVKGRFTISRDNSKNTLYLQMNSLRAEDTAVYYCARDGWQQLAPFDYWGQGTLVTVSSA

SEQ ID NO: 10612 - protein, 123 aa, Artificial Sequence
  Description of Artificial Sequence: Synthetic polypeptide
  KS49 heavy chain
MAQVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARDRRGRKSAGIDYWGQGTLVTVSS

SEQ ID NO: 10613 - protein, 121 aa, Artificial Sequence
  Description of Artificial Sequence: Synthetic polypeptide
  KS83 heavy chain
MAQVQLVESGGGLVQPGGSLRLSCAASGFTFSSYAMHWVRQAPGKGLEWVAVISYDGSNKYYADSVKGRFTISRDNSKNTLYLQMNSLRAEDTAVYYCARTVGATGAFDIWGQGTMVTVSS

SEQ ID NO: 10614 - protein, 119 aa, Artificial Sequence
  Description of Artificial Sequence: Synthetic polypeptide
MAQVQLVQSGGGLVQPGRSLRLSCAASGFSFSEYPMHWVRQAPGRGLESVAVISYDGEYQKYADSVKGRFTISRDDSKSTVYLQMNSLRPEDTAVYYCARTINNGMDVWGQGTTVTVSS

SEQ ID NO: 10615 - protein, 448 aa, Artificial Sequence
  Description of Artificial Sequence: Synthetic polypeptide
  synthetic anti-EphA3 antibody heavy chain
QVQLVQSGAEVKKPGASVKVSCKASGYTFTGYWMNWVRQAPGQGLEWMGDIYPGSGNTNYDEKFQGRVTMTRDTSISTAYMELSRLRSDDTAVYYCARSGYYEEFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10616 - protein, 448 aa, Artificial Sequence
  Description of Artificial Sequence: Synthetic polypeptide
  synthetic anti-EphA3 antibody heavy chain
QVQLVQSGAEVKKPGTSVKVSCKASGYTFTGYWMNWVRQASGQGLEWMGDIYPGSGNTNYDEKFQGRVTMTRDTSISTAYMELSRLRSDDTAVYYCARSGVYEDFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10617 - protein, 448 aa, Artificial Sequence; identical to SEQ ID NO: 4959
  Description of Artificial Sequence: Synthetic polypeptide
  synthetic anti-EphA3 antibody heavy chain

SEQ ID NO: 10618 - protein, 448 aa, Artificial Sequence
  Description of Artificial Sequence: Synthetic polypeptide
  synthetic anti-EphA3 antibody heavy chain
QVQLVQSGAEVKKPGTSVKVSCKASGYTFTGYWMNWVRQASGQGLEWMGDIYPGSGNTNYDEKFQGRVTMTRDTSISTAYMELSRLRSDDTAVYYCARSGYYEEFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10619 - protein, 448 aa, Artificial Sequence; identical to SEQ ID NO: 10615
  Description of Artificial Sequence: Synthetic polypeptide
  synthetic anti-EphA3 antibody heavy chain

SEQ ID NO: 10620 - protein, 448 aa, Artificial Sequence
  Description of Artificial Sequence: Synthetic polypeptide
  synthetic anti-EphA3 antibody heavy chain
EVQLVQSGAEVKKPGESLRISCKGSGYTFTTYWISWVRQMPGQGLEWMGDIYPGSGNTNYAQEFRGRVTITADESTSTAYVELSSLRSEDTAVYYCARSGYYEDFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10621 - protein, 121 aa, Homo sapiens
  MOD_RES (99)..(100): Any naturally occurring amino acid
  MOD_RES (106)..(106): Any naturally occurring amino acid
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARXXDGYNYXYFDYWGQGTLVTVSS

SEQ ID NO: 10622 - protein, 123 aa, Homo sapiens
  MOD_RES (98)..(98): Any naturally occurring amino acid
  MOD_RES (103)..(104): Any naturally occurring amino acid
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARXGYSSXXYYYYGMDVWGQGTTVTVSS

SEQ ID NO: 10623 - protein, 117 aa, Homo sapiens
  MOD_RES (98)..(101): Any naturally occurring amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAXXXXYGMDVWGQGTTVTVSS

SEQ ID NO: 10624 - protein, 117 aa, Homo sapiens
  MOD_RES (98)..(99): Any naturally occurring amino acid
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAXXRDYGMDVWGQGTTVTVSS

SEQ ID NO: 10625 - protein, 129 aa, Homo sapiens
  MOD_RES (100)..(102): Any naturally occurring amino acid
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARXXXITMVRGVYYYYYGMDVWGQGTTVTVSS

SEQ ID NO: 10626 - protein, 450 aa, Artificial Sequence
  Description of Artificial Sequence: Synthetic polypeptide
  Heavy Chain
  MOD_RES (57)..(57): Tyr or an amino acid having a side chain that is nonpolar and/or a side chain that is non-neutral and/or a side chain that is not large
  MOD_RES (59)..(59): Arg or an amino acid having a side chain that is nonpolar and/or is charge neutral or negative and/or is not large
EVQLVESGGGLVQPGGSLRLSCAASGFNIKDTYIHWVRQAPGKGLEWVARIYPTNGXTXYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDTPPPCPRCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10627 - protein, 469 aa, Artificial Sequence
  Description of Artificial Sequence: Synthetic polypeptide
  Anti-HER2 heavy chain
MDWTWRILFLVAAATGTHAEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10628 - protein, 469 aa, Artificial Sequence
  Description of Artificial Sequence: Synthetic polypeptide
  Heavy chain Y57A
MDWTWRILFLVAAATGTHAEVQLVESGGGLVQPGGSLRLSCAASGFNIKDTYIHWVRQAPGKGLEWVARIYPTNGATRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10629 - protein, 469 aa, Artificial Sequence
  Description of Artificial Sequence: Synthetic polypeptide
  Heavy chain R59E
MDWTWRILFLVAAATGTHAEVQLVESGGGLVQPGGSLRLSCAASGFNIKDTYIHWVRQAPGKGLEWVARIYPTNGYTEYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10630 - protein, 450 aa, Artificial Sequence; identical to SEQ ID NO: 10423
  Description of Artificial Sequence: Synthetic polypeptide
  Heavy chain FRP5 (wt IgG human gamma 1)

SEQ ID NO: 10631 - protein, 450 aa, Artificial Sequence
  Description of Artificial Sequence: Synthetic polypeptide
  Heavy chain FRP5 T366W:S354C (knob)
MQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10632 - protein, 450 aa, Artificial Sequence
  Description of Artificial Sequence: Synthetic polypeptide
  Heavy chain FRP5 T366S:L368A:Y407V:Y349C (hole)
MQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 10633 - protein, 140 aa, Mus musculus
MEWIWIFLFFLSGTTGVYSQVQLQQSGAEVARPGASVKLSCKASGYTFTDYYLNWVKQRSGQGLEWIGEIDPGSDSIYYNENLEGRATLTADKSSSTAYMQLNSLTSEDSAVYFCARYGYSRYDVRFVYWGQGTLVTVST

SEQ ID NO: 10634 - protein, 471 aa, Artificial Sequence
  Description of Artificial Sequence: Synthetic polypeptide
MKHLWFFLLLVAAPRWVLSEVQLVESGGGLVQPGRSLKLSCVASGFRFNDFWMTWIRQAPGKGLEWVASITYTGDNTYYAGSVKGRITISRDNAKSTLYLQMNSLRSEDTATYYCTRDDYGGYSPYYMDAWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10635 - protein, 467 aa, Artificial Sequence
  Description of Artificial Sequence: Synthetic polypeptide
MKHLWFFLLLVAAPRWVLSQVKLLQSGAELVKPGASVKLSCKTSGFTFSTSYMSWLKQVPGPSIEWIGWIYAGDGGTKYNQKFKGKATLTVDKSSSTAYMDLSSLTSEDAAVYFCATDGYGDWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10636 - protein, 467 aa, Artificial Sequence
  Description of Artificial Sequence: Synthetic polypeptide
MKHLWFFLLLVAAPRWVLSQVKLLQSGAELVKPGASVKLSCKTSGFTFSTSYMSWLKQVPGPSTEWIGWIYAGDGGTKYNQKFKGKATLTVDKFSSTAYMDLSSLTSEDAAVYFCATDGYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10637 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGQGLEWMGWIYAGDGGTKYNQKFKGRVTLTVDKSTSTAYMELSSLRSEDTAVYYCATDGYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10638 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGQGLEWMGWIYAGDGGTKYNQKFKGRVTLTADKSTSTAYMELSSLRSEDTAVYYCATDGYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10639 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDGYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10640 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSIEWMGWIYAGDGGTKYNQKFKGRVTLTVDKSTSTAYMELSSLRSEDTAVYYCATDGYGDWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10641 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATEGYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10642 - protein, 464 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDAYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLS

SEQ ID NO: 10643 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDEYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10644 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDFYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10645 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDHYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10646 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDIYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10647 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDKYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10648 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDLYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10649 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDMYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10650 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDQYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10651 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDRYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10652 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDVYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10653 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDWYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10654 - protein, 467 aa, Artificial Sequence
  Description of Artificial Sequence: Synthetic polypeptide
MKHLWFFLLLVAAPRWVLSQVQLVQSGAEVKKPGASVKVSCKASGFTFSTSYMSWVRQAPGPSTEWMGWIYAGDGGTKYNQKFKGRVTLTVDKSTSTAYMELSSLRSEDTAVYYCATDYYGDWFTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10655 - protein, 448 aa, Homo sapiens
QVQLQESGPGLVKPSQTLSLNCTVSGGSISSGGYYWSWIRQHPGKGLEWIGYIHYSGSTYYNPSLKSRITISADTSKNQFSLKLNSVTAADTAVYYCARDRGGGDYGRMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10656 - protein, 228 aa, Artificial Sequence
  Description of Artificial Sequence: Synthetic polypeptide
EVQLVESGGGLVQPGGSLRLSCAASGFTFTGNWIHWVRQAPGKGLEWVGEISPSGGYTDYADSVKGRFTISADTSKNTAYLQMNSLRAEDTAVYYCARESRVSYEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10657 - protein, 228 aa, Artificial Sequence
  Description of Artificial Sequence: Synthetic polypeptide
EVQLVESGGGLVQPGGSLRLSCAASGFTLSGDWIHWVRQAPGKGLEWLGEISAAGGYTDYADSVKGRFTISADTSKNTAYLQMNSLRAEDTAVYYCARESRVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10658 - protein, 228 aa, Artificial Sequence
  Description of Artificial Sequence: Synthetic polypeptide
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESRVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10659 - protein, 228 aa, Artificial Sequence
  Description of Artificial Sequence: Synthetic polypeptide
EVQLVESGGGLVQPGGSLRLSCAASGFTFSGDWIHWVRQAPGKGLEWVGEISPAGAYTDYADSVKGRFTISADTSKNTAYLQMNSLRAEDTAVYYCAREAKVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10660 - protein, 228 aa, Artificial Sequence
  Description of Artificial Sequence: Synthetic polypeptide
EVQLVESGGGLVQPGGSLRLSCAASGFTFTGDWIHWVRQAPGKGLEWVGEISPAGAYTDYADSVKGRFTISADTSKNTAYLQMNSLRAEDTAVYYCAREAKVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10661 - protein, 228 aa, Artificial Sequence
  Description of Artificial Sequence: Synthetic polypeptide
EVQLVESGGGLVQPGGSLRLSCAASGFTLSGDWIHWVRQAPGKGLEWLGEISAAGGYTDYADSVKGRFTISADTSKNTAYLQMNSLRAEDTAVYYCARESKVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10662 - protein, 228 aa, Artificial Sequence
  Description of Artificial Sequence: Synthetic polypeptide
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESKVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 10663 - protein, 712 aa, Artificial Sequence
  Description of Artificial Sequence: Synthetic polypeptide
  Synthetic construct
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIKGGGGSGGGGSGGGGSGGGGSGGGGSQIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10664 - protein, 717 aa, Artificial Sequence
  Description of Artificial Sequence: Synthetic polypeptide
  Synthetic construct
QVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIKGGGGSGGGGSGGGGSGGGGSGGGGSQIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10665 - protein, 712 aa, Artificial Sequence
  Description of Artificial Sequence: Synthetic polypeptide
  Synthetic construct
QVQLVQSGAEVKKPGSSVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGCGTKVEIKGGGGSGGGGSGGGGSGGGGSGGGGSQIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10666 - protein, 717 aa, Artificial Sequence
  Description of Artificial Sequence: Synthetic polypeptide
  Synthetic construct
QVQLVQSGAEVKKPGSSVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGCGTKVEIKGGGGSGGGGSGGGGSGGGGSGGGGSQIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 10667 - protein, 704 aa, Artificial Sequence
  Description of Artificial Sequence: Synthetic polypeptide
  Synthetic construct
QIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSQVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIK

SEQ ID NO: 10668 - protein, 709 aa, Artificial Sequence
  Description of Artificial Sequence: Synthetic polypeptide
  Synthetic construct
QIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSQVQLVQSGAEVKKPGSSVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGQGTKVEIK

SEQ ID NO: 10669 - protein, 704 aa, Artificial Sequence
  Description of Artificial Sequence: Synthetic polypeptide
  Synthetic construct
QIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSQVQLVQSGAEVKKPGSSVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGCGTKVEIK

SEQ ID NO: 10670 - protein, 709 aa, Artificial Sequence
  Description of Artificial Sequence: Synthetic polypeptide
  Synthetic construct
QIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSQVQLVQSGAEVKKPGSSVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKSLISSASYRYSGVPSRFSGSGSGTDFTLTISSLQPEDFATYFCQQYDTYPFTFGCGTKVEIK

SEQ ID NO: 10671 - protein, 709 aa, Artificial Sequence
  Description of Artificial Sequence: Synthetic polypeptide
  Synthetic construct
QIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSQVQLVQSGAEVKKPGESVKVSCKASGYTFTTYYLHWVRQAPGQGLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKLLISSASYRYSGVPSRFSGSGSGTDFTLTISSLQPEDFATYFCQQYDTYPFTFGQGTKVEIK

SEQ ID NO: 10672 - protein, 709 aa, Artificial Sequence
  Description of Artificial Sequence: Synthetic polypeptide
  Synthetic construct
QIQLVQSGPELKKPGETVKISCKASGFTFTDYSIHWVKQAPGKGLKWMGWINTETGEPTYTDDFKGRFAFSLVTSATTAYLQINNLNNEDTATFFCARFIYDPYWGFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSQVQLVQSGAEVKKPGESVKVSCKASGYTFTTYYLHWVRQAPGQCLEWMGWIYPGNVHAQYNEKFKGRVTITADKSTSTAYMELSSLRSEDTAVYYCARSWEGFPYWGQGTTVTVSSGGGGSGGGGSGGGGSGGGGSDIQMTQSPSSLSASVGDRVTITCKASQNVGINVAWYQQKPGKAPKLLISSASYRYSGVPSRFSGSGSGTDFTLTISSLQPEDFATYFCQQYDTYPFTFGCGTKVEIK

SEQ ID NO: 10673 - protein, 119 aa, Artificial Sequence
  Description of Artificial Sequence: Synthetic polypeptide
EVQLVESGGGLVQPGGSLRLSCAASGFTFSSYAMSWVRQAPGKGLEWVAVISGDGGSTYYADSVKGRFTISRDNSKNTLYLQMNSLRAEDTAVYYCARGRVGYSLYDYWGQGTLVTVSS

SEQ ID NO: 10674 - protein, 446 aa, Artificial Sequence; identical to SEQ ID NO: 4986
  Description of Artificial Sequence: Synthetic polypeptide
  Humanized antibody sequence

SEQ ID NO: 10675 - protein, 449 aa, Artificial Sequence; identical to SEQ ID NO: 4997
  Description of Artificial Sequence: Synthetic polypeptide
  Humanized antibody sequence

SEQ ID NO: 10676 - protein, 447 aa, Artificial Sequence; identical to SEQ ID NO: 5008
  Description of Artificial Sequence: Synthetic polypeptide
  Humanized antibody sequence

SEQ ID NO: 10677 - protein, 447 aa, Artificial Sequence; identical to SEQ ID NO: 4989
  Description of Artificial Sequence: Synthetic polypeptide
  Humanized antibody sequence

SEQ ID NO: 10678 - protein, 443 aa, Artificial Sequence; identical to SEQ ID NO: 4990
  Description of Artificial Sequence: Synthetic polypeptide
  Humanized antibody sequence

SEQ ID NO: 10679 - protein, 446 aa, Artificial Sequence; identical to SEQ ID NO: 4991
  Description of Artificial Sequence: Synthetic polypeptide
  Humanized antibody sequence

SEQ ID NO: 10680 - protein, 446 aa, Artificial Sequence; identical to SEQ ID NO: 4991
  Description of Artificial Sequence: Synthetic polypeptide
  Humanized antibody sequence

SEQ ID NO: 10681 - protein, 449 aa, Artificial Sequence; identical to SEQ ID NO: 4993
  Description of Artificial Sequence: Synthetic polypeptide
  Humanized antibody sequence

SEQ ID NO: 10682 - protein, 450 aa, Artificial Sequence; identical to SEQ ID NO: 4994
  Description of Artificial Sequence: Synthetic polypeptide
  Humanized antibody sequence

SEQ ID NO: 10683 - protein, 452 aa, Artificial Sequence; identical to SEQ ID NO: 4995
  Description of Artificial Sequence: Synthetic polypeptide
  Humanized antibody sequence

SEQ ID NO: 10684 - protein, 458 aa, Artificial Sequence; identical to SEQ ID NO: 4996
  Description of Artificial Sequence: Synthetic polypeptide
  Humanized antibody sequence

SEQ ID NO: 10685 - protein, 446 aa, Artificial Sequence; identical to SEQ ID NO: 4998
  Description of Artificial Sequence: Synthetic polypeptide
  Humanized antibody sequence

SEQ ID NO: 10686 - protein, 449 aa, Artificial Sequence; identical to SEQ ID NO: 4999
  Description of Artificial Sequence: Synthetic polypeptide
  Humanized antibody sequence

SEQ ID NO: 10687 - protein, 446 aa, Artificial Sequence; identical to SEQ ID NO: 5000
  Description of Artificial Sequence: Synthetic polypeptide
  Humanized antibody sequence

SEQ ID NO: 10688 - protein, 446 aa, Artificial Sequence; identical to SEQ ID NO: 5001
  Description of Artificial Sequence: Synthetic polypeptide
  Humanized antibody sequence

SEQ ID NO: 10689 - protein, 449 aa, Artificial Sequence; identical to SEQ ID NO: 5002
  Description of Artificial Sequence: Synthetic polypeptide
  Humanized antibody sequence

SEQ ID NO: 10690 - protein, 449 aa, Artificial Sequence; identical to SEQ ID NO: 5003
  Description of Artificial Sequence: Synthetic polypeptide
  Humanized antibody sequence

SEQ ID NO: 10691 - protein, 450 aa, Artificial Sequence; identical to SEQ ID NO: 5004
  Description of Artificial Sequence: Synthetic polypeptide
  Humanized antibody sequence

SEQ ID NO: 10692 - protein, 448 aa, Artificial Sequence; identical to SEQ ID NO: 5005
  Description of Artificial Sequence: Synthetic polypeptide
  Humanized antibody sequence

SEQ ID NO: 10693 - protein, 451 aa, Artificial Sequence; identical to SEQ ID NO: 5006
  Description of Artificial Sequence: Synthetic polypeptide
  Humanized antibody sequence

SEQ ID NO: 10694 - protein, 447 aa, Artificial Sequence; identical to SEQ ID NO: 5007
  Description of Artificial Sequence: Synthetic polypeptide
  Humanized antibody sequence

SEQ ID NO: 10695 - protein, 446 aa, Artificial Sequence; identical to SEQ ID NO: 5009
  Description of Artificial Sequence: Synthetic polypeptide
  Humanized antibody sequence

SEQ ID NO: 10696 - protein, 449 aa, Artificial Sequence; identical to SEQ ID NO: 5010
  Description of Artificial Sequence: Synthetic polypeptide
  Humanized antibody sequence

SEQ ID NO: 10697 - protein, 448 aa, Artificial Sequence; identical to SEQ ID NO: 5011
  Description of Artificial Sequence: Synthetic polypeptide
  Humanized antibody sequence

SEQ ID NO: 10698 - protein, 449 aa, Artificial Sequence; identical to SEQ ID NO: 5012
  Description of Artificial Sequence: Synthetic polypeptide
  Humanized antibody sequence

SEQ ID NO: 10699 - protein, 453 aa, Artificial Sequence; identical to SEQ ID NO: 4987
  Description of Artificial Sequence: Synthetic polypeptide
  Humanized antibody sequence

SEQ ID NO: 10700 - protein, 449 aa, Artificial Sequence; identical to SEQ ID NO: 4988
  Description of Artificial Sequence: Synthetic polypeptide
  Humanized antibody sequence

SEQ ID NO: 10701 - protein, 230 aa, Unknown
  Description of Unknown: heavy chain 5D5 Fab sequence
ZVQLQQSGPELVRPGASVKMSCRASGYTFTSYWLHWVKQRPGQGLEWIGMIDPSNSDTRFNPNFKDKATLNVDRSSNTAYMLLSSLTSADSAVYYCATYGSYVSPLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAAP

SEQ ID NO: 10702 - protein, 141 aa, Artificial Sequence
  Description of Artificial Sequence: Synthetic polypeptide
  HGF 1.24.1 Vh, H3-11
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTVSS

SEQ ID NO: 10703 - protein, 137 aa, Artificial Sequence
  Description of Artificial Sequence: Synthetic polypeptide
  HGF 1.29.1 Vh, 3-33
MEFGLNWVFLVALLRGVQCQVQLVESGGGVVQPGRSLRLSCAASGFTFSSYGMHWVRQAPGKGLEWVAVIWYDGSDKYYADSVKGRFTISRDNSKNTLYLQMNSLRAEDTAVYYCAREDYGEGFDYWGQGTLVTVSS

SEQ ID NO: 10704 - protein, 139 aa, Artificial Sequence
  Description of Artificial Sequence: Synthetic polypeptide
  HGF 1.60.1 Vh, H1-02
MDWTWRILFLVAAATGAHSQVQLVQSGAEVKKPGASVKVSCKASGYTFTGYYINWVRQAPGQGLEWMGWINPNSGGTNYAQKFQGRVTMTRDTSITTAYMELSRLRADDTAVYYCARELELRYYGMDVWGQGTTVTVSS

SEQ ID NO: 10705 - protein, 148 aa, Artificial Sequence
  Description of Artificial Sequence: Synthetic polypeptide
  HGF 1.61.3 Vg, 4-31
MKHLWFFLLLVAAPRWVLSQVQLQESGPGLVKPSQTLSLTCTVSGGSISSDGYYWSWIRQHPGKGLEWIGYIYYSGSTYYNPSLKSRVTISVDTSKNQFSLKLSSVTAADTAVYYCARSHLHYYDSSGYYYGGAFDIWGQGTMVTVSS

SEQ ID NO: 10706 - protein, 139 aa, Artificial Sequence
  Description of Artificial Sequence: Synthetic polypeptide
  HGF 1.74.3 Vh, VG1-02
MDWTWRILFLVAAATGAHSQVQLVQSGAEVKKPGASVKVSCKASGYTFTGYYIHWVRQAPGQGLEWMGWINPNSGGTNYAQKFQGRVTMTRDTSISTAYMELSRLRSDDTAVYYCARELELRYYGMDVWGQGTTVTVSS

SEQ ID NO: 10707 - protein, 144 aa, Artificial Sequence
  Description of Artificial Sequence: Synthetic polypeptide
  HGF 1.75.1 Vh, VG4-31
MKHLWFFLLLVAAPRWVLSQVQLQESGPGLVKPSQTLSLTCTVSGGSISSGGYYWSWIRQHPGKGLEWIGYIYYSGSTYYNPSLKSRVTISVDTSKNQFSLKVSSVTAADTAVYYCARDPLWFGEFDYYGMDVWGQGTTVTVSS

SEQ ID NO: 10708 - protein, 142 aa, Artificial Sequence
  Description of Artificial Sequence: Synthetic polypeptide
  HGF 2.4.4 Vh, VG 4-31
MKHLWFFLLLVAAPRWILSQVQLKESGPGLVKPSQTLSLTCTVSGGSISSGVYYWSWIRQHPGKGLEWIGYFYYSGNTYHNPSLKSRVTISVDTSKNQFSLKLSSVTAADTAVYYCARDRSGYDHPDAFDIWGQGTMVTVSS

SEQ ID NO: 10709 - protein, 139 aa, Artificial Sequence
  Description of Artificial Sequence: Synthetic polypeptide
  HGF 2.12.1 Vg, 4-59
MKHLWFFLLLVAAPRWVLSQVQLQESGPGLVKPSETLSLTCTVSGGSISIYYWSWIRQPPGKGLEWIGYVYYSGSTNYNPSLKSRVTISVDTSKNQFSLKLNSVTAADTAVYYCARGGYDFWSGYFDYWGQGTLVTVSS

SEQ ID NO: 10710 - protein, 140 aa, Artificial Sequence
  Description of Artificial Sequence: Synthetic polypeptide
  HGF Vh 4-31
MKHLWFFLLLVAAPRWVLSQVQLQESGPGLVKPSQTLSLTCTVSGGSISSGGYYWSWIRQHPGKGLEWIGNIYYSGITYYNPSLKSRVTMSVDTSKNQFSLKLSSVTAADTAVYYCARDPLYGDYGFDPWGQGTLVTVSS

SEQ ID NO: 10711 - protein, 139 aa, Artificial Sequence
  Description of Artificial Sequence: Synthetic polypeptide
  HGF 3.10.1 Vh, VG 4-34
MKHLWFFLLLVAAPRWVLSQVQLQQWGAGLLKPSETLSLTCAVYGGSFSTYYWSWIRQPPGKGLEWIGEINHSGSTNYNPSLKSRVTISVDTSKNQFSLKLSSVTAADTAVYYCARGGYDFWSGYYDYWGQGTLVTVSS

SEQ ID NO: 10712 - protein, 326 aa, Artificial Sequence; identical to SEQ ID NO: 3049
  Description of Artificial Sequence: Synthetic polypeptide
  synthetic human IgG2

SEQ ID NO: 10713 - protein, 469 aa, Artificial Sequence
  Description of Artificial Sequence: Synthetic polypeptide
  HuL2G7 heavy chain
MDCTWRILFLVAAATGTHAEVQLVQSGAEVKKPGASVKVSCKVSGYTFSGNWIEWVRQAPGKGLEWIGEILPGSGNTNYNEKFKGKATMTADTSTDTAYMELSSLRSEDTAVYYCARGGHYYGSSWDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10714 - protein, 121 aa, Artificial Sequence
  Description of Artificial Sequence: Synthetic polypeptide
  synthetic antibody structure
  MOD_RES (20)..(20): Any amino acid
  MOD_RES (34)..(34): Any amino acid
  MOD_RES (43)..(43): Any amino acid
  MOD_RES (50)..(50): Any amino acid
  MOD_RES (52)..(52): Any amino acid
  MOD_RES (54)..(54): Any amino acid
  MOD_RES (57)..(57): Any amino acid
  MOD_RES (59)..(59): Any amino acid
  MOD_RES (99)..(100): Any amino acid
  MOD_RES (103)..(108): Any amino acid
  MOD_RES (116)..(116): Any amino acid
QVQLQQSGAELVKPGASVKXSCKASGYTFTSYWXHWVKQRPGXGLEWIGXIXPXSGXTXYNEKFKGKATLTVDKSSSTAYMQLSSLTSEDSAVVYCARXXYYXXXXXXDYWGQGTXVTVSS

SEQ ID NO: 10715 - protein, 137 aa, Artificial Sequence
  Description of Artificial Sequence: Synthetic polypeptide
MDIRLSLVFLVLFIKGVQCQVQLVESGGGVVQPGRSLRLSCAASGFTFSNYYMTWVRQAPGKGLEWVAYISSGGGSTYYRDSVKGRFTISRDNSKNTLYLQMNSLRAEDTAVYYCAREDYGYWFAYWGQGTLVTVSS

SEQ ID NO: 10716 - protein, 118 aa, Artificial Sequence
  Description of Artificial Sequence: Synthetic polypeptide
EVQLVESGGGLVQPGGSLRLSCAASGFTFSNYYMTWVRQAPGKGLEWVSYISSGGGSTYYRDSVKGRFTISRDNSKNTLYLQMNSLRAEDTAVYYCAREDYGYWFAYWGQGTLVTVSS

SEQ ID NO: 10717 - protein, 452 aa, Homo sapiens
QVELVESGGGLVQPGGSLRLSCAASGFTFSNYWMHWVRQAPGKGLEWVSGISGWSSWTYYADSVKGRFTISRDNSKNTLYLQMNSLRAEDTAVYYCARFGIDAYTKVYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10718 - protein, 122 aa, Artificial Sequence
  Description of Artificial Sequence: Synthetic polypeptide
  synthetic antibody structure
QVQLQQPGAELVKPGASVKLSCKASGYTFTSYWMHWVKQGPGQGLEWIGEIDPSDSYPNYNEKFKGKATLTVDKSSSTAYMQLSSLTSEDSAVYYCASLYYYGTSYGVLDYWGQGTSVTVSS

SEQ ID NO: 10719 - protein, 118 aa, Artificial Sequence
  Description of Artificial Sequence: Synthetic polypeptide
  synthetic antibody structure
QVQFQQSGAELVKPGASVKLSCKASGYTFTSYLMHWIKQRPGRGLEWIGRIDPNNVVTKFNEKFKSKATLTVDKPSSTAYMELSSLTSEDSAVYYCARYAYCRPMDYWGQGTTVTVSS

SEQ ID NO: 10720 - protein, 115 aa, Artificial Sequence
  Description of Artificial Sequence: Synthetic polypeptide
  synthetic antibody structure
VQLQQSGAELMKPGASVKISCKASGYTFSDYWIEWVKQRPGHGLEWIGEILPGSGSTNYHERFKGKATFTADTSSSTAYMQLNSLTSEDSGVYYCLHGNYDFDGWGQGTTLTVSS

SEQ ID NO: 10721 - protein, 137 aa, Homo sapiens; identical to SEQ ID NO: 5359

SEQ ID NO: 10722 - protein, 144 aa, Homo sapiens
MELGLSWIFLLAILKGVQCEVQLVESGGGLVQPGRSLRLSCAASGFTFDDYAMHWVRQAPGKGLEWVSGISWNSGSKGYVDSVKGRFTISRDNAKNSLYLQMNSLRAEDTALYYCAKDIRIGVAASYYFGMDVWGHGTTVTVSS

SEQ ID NO: 10723 - protein, 146 aa, Homo sapiens
MDWTWRILFLVAAATGAHSQVQLVQSGAEVKKPGASVKVSCKASGYTFTSYVMHWVRQAPGQRLEWMGWINAGNGNTKYSQKFQGRVTITRDTSASTVYMELSSLRSEDTAVYYCARGGMPVAGPGYFYYYGMDVWGQGTTVTVSS

SEQ ID NO: 10724 - protein, 472 aa, Artificial Sequence
  Description of Artificial Sequence: Synthetic polypeptide
  Chimeric variable heavy chain comprising sequences from mus musculus and homo sapiens
MGWSWIFFFLLSETAGVLSEVQLQQSGPELVKPGASVRISCKASGYAFTDYYMNWVKQSHGKSLEWVANINPNNGGTNYNQKFKDKATLTVDKSSNTAYMELRSLTSEDTAVYYCARWILYYGRSKWYFDVWGTGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10725 - protein, 472 aa, Homo sapiens
MGWSCIILFLVATATGVHSQVQLVQSGAEVKKPGASVKVSCKASGYAFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10726 - protein, 472 aa, Homo sapiens
MGWSCIILFLVATATGVHSQVQLVQSGAEVKKPGASVKVSCKASGYTFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10727 - protein, 472 aa, Homo sapiens
MGWSCIILFLVATATGVHSQVQLVQSGAEVKKPGASVKVSCKASGYAFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10728 - protein, 472 aa, Homo sapiens
MGWSCIILFLVATATGVHSQVQLVQSGAEVKKPGASVKVSCKASGYTFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10729 - protein, 120 aa, Artificial Sequence
  Description of Artificial Sequence: Synthetic polypeptide
  Completely synthetic amino acid
QVQLKESGPDLVAPSQSLSITCTVSGFSLTNYGVHWVRQFPGKGLEWLGVIWAGGNTNYNSALMSRLTISKDNSKSQVFLKMNSLQTDDTAVYYCAREYGSTYVAWFAHWGQGTLVTVSS

SEQ ID NO: 10730 - protein, 135 aa, Homo sapiens
MKVLSLLYLLTAIPGILSQVQLQESGPGLVKPSETLSLTCTVSGYSITGGYLWNWIRQPPGKGLEWMGYISYDGTNNYKPSLKDRITISRDTSKNQFSLKLSSVTAADTAVYYCARYGRVFFDYWGQGTLVTVSS

SEQ ID NO: 10731 - protein, 135 aa, Homo sapiens
MKVLSLLYLLTAIPGILSQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSS

SEQ ID NO: 10732 - protein, 117 aa, Homo sapiens
QVQLQESGPGLVKPSETLSLTCTVSGYSISGGYLWNWIRQPPGKGLEWIGYISYDGTNNYKPSLKDRVTISVDTSKNQFSLKLSSVTAADTAVYYCARYGRVFFDYWGQGTLVTVSS

SEQ ID NO: 10733 - protein, 134 aa, Homo sapiens
MKVLSLLYLLTAIPGILSQVQLQESGPGLVKPSETLSLTCTVSGYSISGGYLWNWIRQPPGKGLEWIGYISYDGTNNYKPSLKDRVTISVDTSKNQFSLKLSSVTAADTAVYYCARYGRVFFDYWGQGTLVTVS

SEQ ID NO: 10734 - protein, 129 aa, Mus musculus
EVMLVESGGDLVKPGGSLKLSCAASGFTFNNYIMSWVRQTPEKRLEWVATISGGGSYTFYPDSVKGRFSISRDNAKNTLYLQMSSLRSEDTAMYFCTRNQLLTGMINPLTTPRAWFTYWGQGTLVTVSA

SEQ ID NO: 10735 - protein, 129 aa, Artificial Sequence
  Description of Artificial Sequence: Synthetic polypeptide
  Chemically synthesized humanized antibody, heavy chain
EVQLVESGGDLVQPGGSLRLSCAASGFTFNNYIMSWVRQAPGKGLEWVATISGGGSYTFYPDSVKGRFTISRDNSKNTLYLQMNSLRAEDTAVYFCTRNQLLTGMINPLTTPRAWFTYWGQGTLVTVSS

SEQ ID NO: 10736 - protein, 455 aa, Artificial Sequence
  Description of Artificial Sequence: Synthetic polypeptide
  Humanized
QVQLVQSGAEVKKPGSSVKVSCKASGFYIKDTYMHWVRQAPGQGLEWMGTIDPANGNTKYVPKFQGRVTITADESTSTAYMELSSLRSEDTAVYYCARSIYDDYHYDDYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10737 - protein, 449 aa, Artificial Sequence
  Description of Artificial Sequence: Synthetic polypeptide
  Humanised
QVQLVQSGAEVKKPGSSVKVSCKASGFYIKDTYMHWVRQAPGQGLEWMGTIDPANGNTKYVPKFQGRVTITADESTSTAYMELSSLRSEDTAVYYCARSIYDDYHVDDYYAMDYWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 10738 - protein, 456 aa, Artificial Sequence
  Description of Artificial Sequence: Synthetic polypeptide
  Humanized
QVQLVQSGAEVKKPGASVKVSCKVSGEISTGYYFHWVRQAPGKGLEWMGRIDPEDDSTKYAERFKDRVTMTEDTSTDTAYMELSSLRSEDTAVYYCTTWRIYRDSSGRPFYVMDAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10739 - protein, 140 aa, Unknown
  Description of Unknown: Murinae gen. sp. sequence
MNRLTSSLLLLIVPAYVLSQVTLKESGPGILQPSQTLSLTCSFSGFSLSTSGMGVSWIRQPSGKGLEWLAHIYWDDDKRYNPSLKSRLTISKDTSSNQVFLKITSVDTADTATYYCARRETVFYWYFDVWGAGTTVTVSS

SEQ ID NO: 10740 - protein, 141 aa, Artificial Sequence
  Description of Artificial Sequence: Synthetic polypeptide
  synthetic construct
MVLQTQVFISLLLWISGAYGQVTLRESGPALVKPTQTLTLTCTFSGFSLSTSGMGVSWIRQPPGKGLEWLAHIYWDDDKRYNPSLKSRLTISKDTSRNQVVLTMTNMDPVDTATYYCARRETVFYWYFDVWGRGTPVTVSS

SEQ ID NO: 10741 - protein, 445 aa, Artificial Sequence
  Description of Artificial Sequence: Synthetic polypeptide
  Humanised
QVTLRESGPALVKPTQTLTLTCTFSGFSLSTSGMGVSWIRQPPGKGLEWLAHIYWDDDKRYNPSLKSRLTISKDTSRNQVVLTMTNMDPVDTATYYCARRETVFYWYFDVWGRGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 10742 - protein, 443 aa, Artificial Sequence
  Description of Artificial Sequence: Synthetic polypeptide
  Humanised
QVTLRESGPALVKPTQTLTLTCTVSGFSLTSYSVHWVRQPPGKGLEWLGVIWASGGTDYNSALMSRLSISKDTSRNQVVLTMTNMDPVDTATYYCARDPPSSLLRLDYWGRGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 10743 - protein, 166 aa, Oryctolagus cuniculus; identical to SEQ ID NO: 5053

SEQ ID NO: 10744 - protein, 109 aa, Oryctolagus cuniculus; identical to SEQ ID NO: 5054

SEQ ID NO: 10745 - protein, 109 aa, Oryctolagus cuniculus; identical to SEQ ID NO: 5055

SEQ ID NO: 10746 - protein, 128 aa, Oryctolagus cuniculus; identical to SEQ ID NO: 5056

SEQ ID NO: 10747 - protein, 126 aa, Oryctolagus cuniculus; identical to SEQ ID NO: 5057

SEQ ID NO: 10748 - protein, 129 aa, Oryctolagus cuniculus
METGLRWLLLVAVLKGVQCQSVEESGGRLVTPGTPLTLTCTVSGLSLSSNTINWVRQAPGKGLEWIGYIWSGGSTYYASWVNGRFTISKTSTTVDLKITSPTTEDTATYFCARGGYASGGYPYATRLDL

SEQ ID NO: 10749 - protein, 123 aa, Oryctolagus cuniculus; identical to SEQ ID NO: 5059

SEQ ID NO: 10750 - protein, 109 aa, Oryctolagus cuniculus; identical to SEQ ID NO: 5060

SEQ ID NO: 10751 - protein, 128 aa, Oryctolagus cuniculus; identical to SEQ ID NO: 5061

SEQ ID NO: 10752 - protein, 109 aa, Oryctolagus cuniculus; identical to SEQ ID NO: 5062

SEQ ID NO: 10753 - protein, 128 aa, Oryctolagus cuniculus; identical to SEQ ID NO: 5063

SEQ ID NO: 10754 - protein, 133 aa, Oryctolagus cuniculus; identical to SEQ ID NO: 5064

SEQ ID NO: 10755 - protein, 167 aa, Oryctolagus cuniculus; identical to SEQ ID NO: 5065

SEQ ID NO: 10756 - protein, 119 aa, Oryctolagus cuniculus; identical to SEQ ID NO: 5066

SEQ ID NO: 10757 - protein, 125 aa, Oryctolagus cuniculus; identical to SEQ ID NO: 5067

SEQ ID NO: 10758 - protein, 121 aa, Oryctolagus cuniculus; identical to SEQ ID NO: 5068

SEQ ID NO: 10759 - protein, 128 aa, Oryctolagus cuniculus; identical to SEQ ID NO: 5069

SEQ ID NO: 10760 - protein, 123 aa, Oryctolagus cuniculus; identical to SEQ ID NO: 5070

SEQ ID NO: 10761 - protein, 166 aa, Oryctolagus cuniculus; identical to SEQ ID NO: 5071

SEQ ID NO: 10762 - protein, 129 aa, Oryctolagus cuniculus; identical to SEQ ID NO: 5072

SEQ ID NO: 10763 - protein, 130 aa, Oryctolagus cuniculus
METGLRWLLLVAVLKGVQCQSLEEAGGRLVTPGTPLTLTCTVSGIDLSSYAMGWVRQAPGKGLEYIGIISSSGSTYYATWAKGRFTISQASSTTVDLKITSPTTEDSATYFCARGGAGSGGVWLLDGFDP

SEQ ID NO: 10764 - protein, 130 aa, Oryctolagus cuniculus
METGLRWLLLVAVLKGVQCQEQLKESGGRLVTPGTPLTLTCTVSGFSLNDYAVGWFRQAPGKGLEWIGYIRSSGTTAYATWAKGRFTISATSTTVDLKITSPTTEDTATYFCARGGAGSSGVWILDGFAP

SEQ ID NO: 10765 - protein, 130 aa, Oryctolagus cuniculus
METGLRWLLLVAVLKGVQCQSLEESGGDLVKPGASLTLTCTASGFSFTSTYYIYWVRQAPGKGLEWIACIDAGSSGSTYYATWVNGRFTISKTSSTTVTLQMTSLTAADTATYFCAKWDYGGNVGWGYDL

SEQ ID NO: 10766 - protein, 127 aa, Oryctolagus cuniculus; identical to SEQ ID NO: 5076

SEQ ID NO: 10767 - protein, 166 aa, Oryctolagus cuniculus; identical to SEQ ID NO: 5077

SEQ ID NO: 10768 - protein, 130 aa, Oryctolagus cuniculus
METGLRWLLLVAVLKGVQCQSLEESGGDLVKPGASLTLTCTTSGFSFSSSYFICWVRQAPGKGLEWIACIYGGDGSTYYASWAKGRFTISKTSSTTVTLQMTSLTAADTATYFCAREWAYSQGYFGAFDL

SEQ ID NO: 10769 - protein, 124 aa, Oryctolagus cuniculus; identical to SEQ ID NO: 5079

SEQ ID NO: 10770 - protein, 124 aa, Oryctolagus cuniculus; identical to SEQ ID NO: 5080

SEQ ID NO: 10771 - protein, 127 aa, Oryctolagus cuniculus; identical to SEQ ID NO: 5081

SEQ ID NO: 10772 - protein, 126 aa, Oryctolagus cuniculus; identical to SEQ ID NO: 5082

SEQ ID NO: 10773 - protein, 128 aa, Oryctolagus cuniculus; identical to SEQ ID NO: 5083

SEQ ID NO: 10774 - protein, 122 aa, Oryctolagus cuniculus
METGLRWLLLVAVLKGVQCQSLEESGGRLVTPGTPLTLTCTVSGFSLNRNSITWVRQAPGEGLEWIGIITGSGRTYYANWAKGRFTISKTSTTVDLKMTSPTTEDTATYFCARGHPGLGSGN

SEQ ID NO: 10775 - protein, 122 aa, Oryctolagus cuniculus; identical to SEQ ID NO: 5086

SEQ ID NO: 10776 - protein, 124 aa, Oryctolagus cuniculus; identical to SEQ ID NO: 5087

SEQ ID NO: 10777 - protein, 167 aa, Oryctolagus cuniculus; identical to SEQ ID NO: 5088

SEQ ID NO: 10778 - protein, 128 aa, Oryctolagus cuniculus; identical to SEQ ID NO: 5089

SEQ ID NO: 10779 - protein, 124 aa, Oryctolagus cuniculus; identical to SEQ ID NO: 5090

SEQ ID NO: 10780 - protein, 117 aa, Oryctolagus cuniculus; identical to SEQ ID NO: 5091

SEQ ID NO: 10781 - protein, 120 aa, Homo sapiens; identical to SEQ ID NO: 5095

SEQ ID NO: 10782 - protein, 120 aa, Homo sapiens; identical to SEQ ID NO: 5096

SEQ ID NO: 10783 - protein, 166 aa, Oryctolagus cuniculus; identical to SEQ ID NO: 5097

SEQ ID NO: 10784 - protein, 125 aa, Oryctolagus cuniculus; identical to SEQ ID NO: 5098

SEQ ID NO: 10785 - protein, 450 aa, Oryctolagus cuniculus; identical to SEQ ID NO: 5099

SEQ ID NO: 10786 - protein, 450 aa, Oryctolagus cuniculus; identical to SEQ ID NO: 5100

SEQ ID NO: 10787 - protein, 126 aa, Oryctolagus cuniculus; identical to SEQ ID NO: 5101

SEQ ID NO: 10788 - protein, 125 aa, Oryctolagus cuniculus; identical to SEQ ID NO: 5102

SEQ ID NO: 10789 - protein, 126 aa, Oryctolagus cuniculus; identical to SEQ ID NO: 5103

SEQ ID NO: 10790 - protein, 122 aa, Oryctolagus cuniculus; identical to SEQ ID NO: 5104

SEQ ID NO: 10791 - protein, 128 aa, Oryctolagus cuniculus; identical to SEQ ID NO: 5105

SEQ ID NO: 10792 - protein, 125 aa, Oryctolagus cuniculus; identical to SEQ ID NO: 5106

SEQ ID NO: 10793 - protein, 450 aa, Oryctolagus cuniculus; identical to SEQ ID NO: 5107

SEQ ID NO: 10794 - protein, 450 aa, Oryctolagus cuniculus; identical to SEQ ID NO: 5108

SEQ ID NO: 10795 - protein, 164 aa, Oryctolagus cuniculus; identical to SEQ ID NO: 5109

SEQ ID NO: 10796 - protein, 450 aa, Oryctolagus cuniculus; identical to SEQ ID NO: 5110

SEQ ID NO: 10797 - protein, 468 aa, Oryctolagus cuniculus; identical to SEQ ID NO: 5111

SEQ ID NO: 10798 - protein, 170 aa, Oryctolagus cuniculus; identical to SEQ ID NO: 5112

SEQ ID NO: 10799 - protein, 253 aa, Artificial Sequence
  Description of Artificial Sequence: Synthetic polypeptide
  recombinant immunoglobulin
MKKNIAFLLASMFVFSIATNAYAEIQLQQSGPELMKPGASVKISCKASGYSFSSHYMHWVKQSHGKSLEWIGYIDPSNGETTYNQKFKGKATLTVDTSSSTANVHLSSLTSDDSAVYFCARGDYRYNGDWFFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 10800 - protein, 443 aa, Artificial Sequence
  Description of Artificial Sequence: Synthetic polypeptide
QVQLHQPGAELVKPGAPVKLSCKASGYTFTSYWMNWVKQRPGRGLEWIGRIDPSDSETHYNQKFKDKATLTVDKSSSTAYIQLSSLTSEDSAVYYCAKVGRGYFDYWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 10801 - protein, 449 aa, Artificial Sequence; identical to SEQ ID NO: 5020
  Description of Artificial Sequence: Synthetic polypeptide
  Antibody A heavy chain

SEQ ID NO: 10802 - protein, 461 aa, Artificial Sequence
  Description of Artificial Sequence: Synthetic polypeptide
  AntiMET-R heavy chain
MGWSYIILFLVATATDGHSQVQLQQPGTELVKPGASVKLSCKASGYTFTSYWIHWVKQRPGQGLEWIGEINPSSGRTNYNEKFKNKVTVTVDKSSTTAYMQLSNLTSEDSAVYYCASRGYWGQGTTLTVSSAKTTAPSVYPLAPVCGNTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 10803 - protein, 499 aa, Homo sapiens
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPG

SEQ ID NO: 10804 - protein, 467 aa, Mus musculus; identical to SEQ ID NO: 7292

SEQ ID NO: 10805 - protein, 122 aa, Mus musculus
EVQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSS

SEQ ID NO: 10806 - protein, 107 aa, Artificial Sequence
  Description of Artificial Sequence: Synthetic polypeptide
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIK

SEQ ID NO: 10807 - protein, 120 aa, Artificial Sequence
  Description of Artificial Sequence: Synthetic polypeptide
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 10808 - protein, 446 aa, Artificial Sequence
  Description of Artificial Sequence: Synthetic polypeptide
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 10809 - protein, 446 aa, Artificial Sequence
  Description of Artificial Sequence: Synthetic polypeptide
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 10810 - protein, 446 aa, Artificial Sequence; identical to SEQ ID NO: 10809
  Description of Artificial Sequence: Synthetic polypeptide

SEQ ID NO: 10811 - protein, 447 aa, Artificial Sequence
  Description of Artificial Sequence: Synthetic polypeptide
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10812 - protein, 98 aa, Artificial Sequence
  Description of Artificial Sequence: Synthetic polypeptide
QVQLQQPGAELVKPGASVKLSCKASGYTFTSYWMHWVKQRPGRGLEWIGRIDPNSGGTKYNEKFKSKATLTVDKPSSTAYMQLSSLTSEDSAVYYCAR

SEQ ID NO: 10813 - protein, 107 aa, Artificial Sequence
  Description of Artificial Sequence: Synthetic polypeptide
DIVMTQSHKFMSTSVGDRVSITCKASQDVGTAVAWYQQKPGQSPKLLIYWASTRHTGVPDRFTGSGSGTDFTLTISNVQSEDLADYFCQQYSSYPLTFGAGSKLELK

SEQ ID NO: 10814 - protein, 446 aa, Artificial Sequence
  Description of Artificial Sequence: Synthetic polypeptide
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 10815 - protein, 118 aa, Artificial Sequence
  Description of Artificial Sequence: Synthetic polypeptide
EVQLLESGGGLVQPGGSLRLSCAASGFTFSSYIMMWVRQAPGKGLEWVSSIYPSGGITFYADKGRFTISRDNSKNTLYLQMNSLRAEDTAVYYCARIKLGTVTTVDYWGQGTLVTVSS

SEQ ID NO: 10816 - protein, 253 aa, Artificial Sequence [sequence omitted]

SEQ ID NO: 10817 - protein, 120 aa, Artificial Sequence
  Description of Artificial Sequence: Synthetic polypeptide
EVQLVESGGGLVQPGGSLRLSCAASGFTFSNYWISWVRQAPGKGLEWVGDISPDGGYTYYADSVKGRFTISADTSKNTAYLQMNSLRAEDTAVYYCARESWWSAWVMDYWGQGTLVTVSS

SEQ ID NO: 10818 - protein, 118 aa, Artificial Sequence
  Description of Artificial Sequence: Synthetic polypeptide
EVQLVESGGGLVQPGGSLRLSCAASGFTFSNSDIHWVRQAPGKGLEWVGWIYPADGSTYYADSVKGRFTISADTSKNTAYLQMNSLRAEDTAVYYCAKGSGYYAMDYWGQGTLVTVSS

SEQ ID NO: 10819 - protein, 119 aa, Artificial Sequence
  Description of Artificial Sequence: Synthetic polypeptide
EVQLVESGGGLVQPGGSLRLSCAASGFTFTDTGIHWVRQAPGKGLEWVGVISPASGYTDYADSVKGRFTISADTSKNTAYLQMNSLRAEDTAVYYCARDIYYFFGFDYWGQGTLVTVSS

SEQ ID NO: 10820 - protein, 119 aa, Artificial Sequence
  Description of Artificial Sequence: Synthetic polypeptide
EVQLVESGGGLVQPGGSLRLSCAASGFTFTSYWIHWVRQAPGKGLEWVGEINPHDGSTNYADSVKGRFTISADTSKNTAYLQMNSLRAEDTAVYYCAREVFLGYAMDYWGQGTLVTVSS

SEQ ID NO: 10821 - protein, 117 aa, Artificial Sequence
  Description of Artificial Sequence: Synthetic polypeptide
EVQLVESGGGLVQPGGSLRLSCAASGFTFSGSDIHWVRQAPGKGLEWVAWIYPADGSTYYADSVKGRFTISADTSKNTAYLQMNSLRAEDTAVYYCAKPSWGFFDYWGQGTLVTVSS

SEQ ID NO: 10822 - protein, 120 aa, Artificial Sequence
  Description of Artificial Sequence: Synthetic polypeptide
EVQLVESGGGLVQPGGSLRLSCAASGFTFSNSYISWVRQAPGKGLEWVAGINPNGGYTYYADSVKGRFTISADTSKNTAYLQMNSLRAEDTAVYYCAREWYFGGYVMDYWGQGTLVTVSS

SEQ ID NO: 10823 - protein, 120 aa, Artificial Sequence
  Description of Artificial Sequence: Synthetic polypeptide
EVQLVESGGGLVQPGGSLRLSCAASGFTFSNSYISWVRQAPGKGLEWVAGINPNGGYTYYADSVKGRFTISADTSKNTAYLQMNSLRAEDTAVYYCAREWYFDGYVMDYWGQGTLVTVSS

SEQ ID NO: 10824 - protein, 120 aa, Artificial Sequence
  Description of Artificial Sequence: Synthetic polypeptide
EVQLVESGGGLVQPGGSLRLSCAASGFTFSNSYISWVRQAPGKGLEWVAGINPNGGYTYYADSVKGRFTISADTSKNTAYLQMNSLRAEDTAVYYCAREWYYGGYVMDYWGQGTLVTVSS

SEQ ID NO: 10825 - protein, 120 aa, Artificial Sequence
  Description of Artificial Sequence: Synthetic polypeptide
EVQLVESGGGLVQPGGSLRLSCAASGFTFSNSYISWVRQAPGKGLEWVAAINPAGGYTYYADSVKGRFTISADTSKNTAYLQMNSLRAEDTAVYYCAREWYFGGYVMDYWGQGTLVTVSS

SEQ ID NO: 10826 - protein, 450 aa, Artificial Sequence
  Description of Artificial Sequence: Synthetic polypeptide
  Heavy chain anti-Tac (wt IgG human gamma 1)
MQVQLQQSGPELKKPGETVKISCKASGYPFTNYGMNWVKQAPGQGLKWMGWINTSTGESTFADDFKGRFDFSLETSANTAYLQINNLKSEDMATYFCARWEVYHGYVPYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10827 - protein, 119 aa, Homo sapiens
RLQLVQSGAEVRKPGASVKVSCKASGYSFTGHYIHWARQAPGQGLEWMGWINPYSGGTNFPREFQGRVTMTRDTSVNTVYMELTRLTSDDTSVYYCARDHRIVGGLDYWGQGTLVTVSS

SEQ ID NO: 10828 - protein, 119 aa, Homo sapiens
EVQLVQSGAEVRKPGASVKVSCKASGYSFTGHYIHWVRQAPGQGLEWMGWINPYSGGTNFPREFQGRVTMTRDTSVNTVYMELTRLTSDDTSVYYCARDHRIVGGLDYWGQGTLVTVSS

SEQ ID NO: 10829 - protein, 119 aa, Artificial Sequence
  Description of Artificial Sequence: Synthetic polypeptide
  Heavy chain of affinity matured XPA.10.064
EVQLVQSGAEVRKPGASVKVSCKASGYSFTGHYIHWVRQAPGQGLEWMGWINPYSGGTNFPREFQGRVTMTRDTSVNTVYMELTRLTSDDTSVYYCARDQMVHGGLDYWGQGTLVTVSS

SEQ ID NO: 10830 - protein, 119 aa, Artificial Sequence
  Description of Artificial Sequence: Synthetic polypeptide
  Heavy chain of affinity matured XPA.10.064
EVQLVQSGAEVRKPGASVKVSCKASGYSFTGHYIHWVRQAPGQGLEWMGWINPYSGGTNFPREFQGRVTMTRDTSVNTVYMELTRLTSDDTSVYYCARDEMQNGGLDYWGQGTLVTVSS

SEQ ID NO: 10831 - protein, 119 aa, Artificial Sequence
  Description of Artificial Sequence: Synthetic polypeptide
  Heavy chain of affinity matured XPA.10.064
EVQLVQSGAEVRKPGASVKVSCKASGYSFTGHYIHWVRQAPGQGLEWMGWINPYSGGTNFPREFQGRVTMTRDTSVNTVYMELTRLTSDDTSVYYCARDEMTRGGLDYWGQGTLVTVSS

SEQ ID NO: 10832 - protein, 119 aa, Artificial Sequence
  Description of Artificial Sequence: Synthetic polypeptide
  Heavy chain of affinity matured XPA.10.064
EVQLVQSGAEVRKPGASVKVSCKASGYSFTGHYIHWVRQAPGQGLEWMGWINPYSGGTNFPREFQGRVTMTRDTSVNTVYMELTRLTSDDTSVYYCARDEMHVGGLDYWGQGTLVTVSS

SEQ ID NO: 10833 - protein, 119 aa, Artificial Sequence
  Description of Artificial Sequence: Synthetic polypeptide
  Heavy chain of affinity matured XPA.10.064
EVQLVQSGAEVRKPGASVKVSCKASGYSFTGHYIHWVRQAPGQGLEWMGWINPYSGGTNFPREFQGRVTMTRDTSVNTVYMELTRLTSDDTSVYYCARDEMVWGGLDYWGQGTLVTVSS

SEQ ID NO: 10834 - protein, 472 aa, Homo sapiens
MGWSCIILFLVATATGVHSQVQLVQSGAEVKKPGASVKVSCKASGYTFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10835 - protein, 120 aa, Artificial Sequence
  Description of Artificial Sequence: Synthetic polypeptide
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 10836 - protein, 447 aa, Artificial Sequence
  Description of Artificial Sequence: Synthetic polypeptide
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10837 - protein, 120 aa, Artificial Sequence
  Description of Artificial Sequence: Synthetic polypeptide
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 10838 - protein, 447 aa, Artificial Sequence
  Description of Artificial Sequence: Synthetic polypeptide
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10839 - protein, 120 aa, Artificial Sequence
  Description of Artificial Sequence: Synthetic polypeptide
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSS

SEQ ID NO: 10840 - protein, 447 aa, Artificial Sequence
  Description of Artificial Sequence: Synthetic polypeptide
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10841 - protein, 120 aa, Artificial Sequence
  Description of Artificial Sequence: Synthetic polypeptide
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 10842 - protein, 447 aa, Artificial Sequence
  Description of Artificial Sequence: Synthetic polypeptide
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10843 - protein, 120 aa, Artificial Sequence
  Description of Artificial Sequence: Synthetic polypeptide
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 10844 - protein, 447 aa, Artificial Sequence
  Description of Artificial Sequence: Synthetic polypeptide
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10845 - protein, 120 aa, Artificial Sequence
  Description of Artificial Sequence: Synthetic polypeptide
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSS

SEQ ID NO: 10846 - protein, 447 aa, Artificial Sequence
  Description of Artificial Sequence: Synthetic polypeptide
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10847 - protein, 120 aa, Artificial Sequence
  Description of Artificial Sequence: Synthetic polypeptide
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSS

SEQ ID NO: 10848 - protein, 447 aa, Artificial Sequence
  Description of Artificial Sequence: Synthetic polypeptide
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10849 - protein, 137 aa, Homo sapiens; identical to SEQ ID NO: 5360

SEQ ID NO: 10850 - protein, 137 aa, Artificial Sequence; identical to SEQ ID NO: 5360
  Description of Artificial Sequence: Synthetic polypeptide
  Synthetic Construct

SEQ ID NO: 10851 - protein, 137 aa, Homo sapiens; identical to SEQ ID NO: 5361

SEQ ID NO: 10852 - protein, 137 aa, Artificial Sequence; identical to SEQ ID NO: 5361
  Description of Artificial Sequence: Synthetic polypeptide
  Synthetic Construct

SEQ ID NO: 10853 - protein, 127 aa, Lama glama
EVQLVESGGGLVQAGGSLRLSCAASGRTFSNYVMGWFRQAPGKERDFVVGIGRSGGDNTYYADSVKGRFTISWDNAKNTMYLQMNSLKPEDTAVYYCAASTYSRDTIFTKWANYNYWGQGTQVTVSS

SEQ ID NO: 10854 - protein, 127 aa, Lama glama
QVQLQESGGGLVKAGGSLRLSCAASGRTFSSYVMGWFRQAPGKEREFVGAIHWSGGRTYYADSVKGRFTISSDNAKNTLYLQMNSLKPEDTAVYYCAASRIIYSYVNYVNPGEYDYWGQGTQVTVSS

SEQ ID NO: 10855 - protein, 122 aa, Lama glama
EVQLVESGGGLVQPGGSLRLSCAASGFTFSSHYMSWFRQAPGKEREFVAAITSSSRTYYTESVKGRFTISRDNAKNTVYLQMNSLKSEDTAVYYCAADRTFYGSTWSKYDYRGQGTQVTVSS

SEQ ID NO: 10856 - protein, 129 aa, Lama glama
QVQLQESGGGLVQAGGSLRLSCAASGRTFSKYAMGWFRQAPGKEREFVSAISWSDGSTYYADSVKGRFTISRDNAKNTVYLQVNSLKPEDTAVYYCAATYLVDVWAVHVPIRPYEYDYWGQGTQVTVSS

SEQ ID NO: 10857 - protein, 125 aa, Lama glama
QVQLQDSGGGLVQAGDSLRLSCAASGRSFGGYAMGWFRQAPGKEREFVAAISWSGGSTYYADSLKGRFTISRDNAKNTVYLQMNSLKPEDTALYYCAAGLRPSPNYNHERSYDYWGQGTQVTVSS

SEQ ID NO: 10858 - protein, 129 aa, Lama glama
QVQLQESGGGLVQAGGSLLLSCAASGRTFSSYAMGWFRQAPGKEREFVAAINWSGGSTSYADSVKGRFTISRDNTKNTVYLQMNSLKPEDTAAFYCAATYNPYSRDHYFPRMTTEYDYWGQGTQVTVSS

SEQ ID NO: 10859 - protein, 122 aa, Lama glama
QVQLQESGGRLVQTGGSLRLSCAASGGTFGTYALGWFRQAPGKEREFVAAISRFGSTYYADSVKGRFTISRDNANNTVYLEMNSLKPEDTAVYYCAAREGVALGLRNDANYWGQGTQVTVSS

SEQ ID NO: 10860 - protein, 121 aa, Lama glama
QVQLQDSGGGLVQAGGSLRLSCAASGGTFSSYAMGWFRQAPGKEREFVAAIGLNTYYADSVKGRFTISRDNAKNTVYLQMNSLKPEDTAVYYCAARTSGVVGGTPKRYDYWGQGTQVTVSS

SEQ ID NO: 10861 - protein, 122 aa, Lama glama
QVQLQESGGGSVQAGGSLKLSCAASGRGFSRYAMGWFRQAPGQDREFVATISWTNSTDYADSVKGRFAISRDNAKNTAYLQMNSLKPEDTAVYYCAADKWASSTRSIDYDYWGQGIQVTVSS

SEQ ID NO: 10862 - protein, 123 aa, Lama glama
QVQLQESGGGLVQAGGSLRLSCAASGRTFSNYAMGWFRQAPGKEREFVAAINWGGGNTYYADSVKGRFTISRDNAKNTVYLQMNSLKPEDTAVYYCAASEWGGSDYDHDYDYWGQGTQVTVSS

SEQ ID NO: 10863 - protein, 123 aa, Lama glama
EVQLVESGGGLVQAGGSLRLSCAASGRSFSSYAMAWFRQAPGKEREFVAAISWGGGSTYYAVSVKGRFTISRDNAKNTVYLQMNSLKPEDTARYYCAADETFHSSAYGEYEYWGQGTQVTVSS

SEQ ID NO: 10864 - protein, 133 aa, Lama glama
EVQLVESGGGLVQAGGSLRLSCTASGRTFSSYAMGWFRQTPGKEREFVAAITSSGGSTYYADSVKGRFTISRDNAKSTMYLQMDSLMLDDTSVYYCAADSSRPQYSDSALRRILSLSNSYPYWGQGTQVTVSS

SEQ ID NO: 10865 - protein, 120 aa, Lama glama
EVQLVESGGGLVQPGGSLRLSCVASGFTFADYAMSWVRQAPGKGLQWVSSISYNGDTTYYAESMKDRFTISRDNAKNTLYLQMNSLKSEDTAVYYCASSGSYYPGHFESWGQGTQVTVSS

SEQ ID NO: 10866 - protein, 121 aa, Lama glama
QVQLQESGGGLVQAGGSLRLSCAASGRTFSGYAMGWFRQAPGEEREFVAAISWRGTSTYYGDSAKGRFTISRDNAKNTVYLQMNSLKPEDTAVYYCAAGSHSDYAPDYDYWGQGTQVTVSS

SEQ ID NO: 10867 - protein, 123 aa, Lama glama
QVQLQESGGGLVQAGGSLRLSCAASGRTFSSYAIGWFRQAPGKEREFVAAISWGGSNTYYADSVKGRFTISRDNAKNTVYLQMNSLKPEDTAVYYCAAGEVSNSDYAYEYDYWGQGTQVTVSS

SEQ ID NO: 10868 - protein, 122 aa, Lama glama
QVQLQESGGGLVQTGGSLRLSCAASGRYIMGWFRQAPGKEREFVAGISRSGASTAYADSVKDRFTISRDSALNTVYLQMNSLKAEDTAVYFCAAALAIRLGIPRGETEYEYWGQGTQVTVSS

SEQ ID NO: 10869 - protein, 121 aa, Lama glama
QVKLEESGGGLVQAGGSLRLSCSASGLTFSNYAMAWFRQAPGKEREFVATISQRGGMRHYLDSVKDRFTISRDNAKNTVYLQMNSLKPDDTAVYYCAADLMYGVDRRYDYWGRGTQVTVSS

SEQ ID NO: 10870 - protein, 127 aa, Lama glama
QVKLEESGGGLVQAGDSLRLSCAASGRSFSSITMGWFRQAPGKERQFVSAINSNGNRYYADSVKGRFTISRDNAKNTVYLQMNSLKPEDTAVYYCAAVQAYSSSSDYYSQEGAYDYWGQGTQVTVSS

SEQ ID NO: 10871 - protein, 126 aa, Lama glama
EVQLVESGGGLVQAGGSLRLSCAVSGRTFSSMGWFRQAPGKEREFVATINLSGDRTDYADSVKGRFTISRDNPKNTVYLQMDSLEPEDSAVYYCAGTSLYPSNLRYYTLPGTYADWGQGTQVTVSS

SEQ ID NO: 10872 - protein, 126 aa, Lama glama
QVKLEESGGGLVQAGGSLRLSCAASGSIFSINAMGWYRQAPGKQRELVARITGTGTGITGAVSTNYADSVKGRFTISRDNARNTVYLQMNSLKPEDTAVYYCAADRSRTIVVPDYWGQGTQVTVSS

SEQ ID NO: 10873 - protein, 126 aa, Lama glama
QVQLQDSGGGLVQAGGSLRLSCAASRFSSAQYAIGWFRQAPGKEREGVSYITFSGGPTGYADSVKGRFTVSRDNAKNTVYLQMNSLKPEDTAVYYCAARPYTRPGSMWVSSLYDNWGQGTQVTVSS

SEQ ID NO: 10874 - protein, 123 aa, Lama glama
QVQLQESGGRLVQAGGSLRLSCAASEHTFRGYAIGWFRQAPGKEREFVSSITYDGTLTNYADSVTGRFTISRDNAKNTVYLQMNSLKPEDTAVYVCAAGYSYRYTTLNQYDSWGQGTQVTVSS

SEQ ID NO: 10875 - protein, 115 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSS

SEQ ID NO: 10876 - protein, 115 aa, Lama glama
QVQLQESGGGLVQPGNSLRLSCAASGFTFRNFGMSWVRQAPGKEPEWVSSISGSGSNTIYADSVKDRFTISRDNAKSTLYLQMNSLKPEDTAVYYCTIGGSLSRSSQGTQVTVSS

SEQ ID NO: 10877 - protein, 114 aa, Lama glama
QVQLQESGGGLVQPGGSLRLTCTASGFTFSSFGMSWVRQAPGKGLEWVSAISSDSGTKNYADSVKGRFTISRDNAKKMLFLQMNSLRPEDTAVYYCVIGRGSPSSQGTQVTVSS

SEQ ID NO: 10878 - protein, 114 aa, Lama glama
QVQLQESGGGLVQPGGSLRLTCTASGFTFRSFGMSWVRQAPGKGLEWVSAISADGSDKRYADSVKGRFTISRDNGKKMLTLDMNSLKPEDTAVYYCVIGRGSPASQGTQVTVSS

SEQ ID NO: 10879 - protein, 254 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAEVQLVESGGGLVQAGGSLRLSCAASGRTFSNYVMGWFRQAPGKERDFVVGIGRSGGDNTYYADSVKGRFTISWDNAKNTMYLQMNSLKPEDTAVYYCAASTYSRDTIFTKWANYNYWGQGTQVTVSS

SEQ ID NO: 10880 - protein, 254 aa, Lama glama
QVQLQESGGGLVQPGNSLRLSCAASGFTFRNFGMSWVRQAPGKEPEWVSSISGSGSNTIYADSVKDRFTISRDNAKSTLYLQMNSLKPEDTAVYYCTIGGSLSRSSQGTQVTVSSEPKTPKPQPAAAQVQLQESGGGLVKAGGSLRLSCAASGRTFSSYVMGWFRQAPGKEREFVGAIHWSGGRTYYADSVKGRFTISSDNAKNTLYLQMNSLKPEDTAVYYCAASRIIYSYVNYVNPGEYDYWGQGTQVTVSS

SEQ ID NO: 10881 - protein, 249 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAEVQLVESGGGLVQPGGSLRLSCAASGFTFSSHYMSWFRQAPGKEREFVAAITSSSRTYYTESVKGRFTISRDNAKNTVYLQMNSLKSEDTAVYYCAADRTFYGSTWSKYDYRGQGTQVTVSS

SEQ ID NO: 10882 - protein, 249 aa, Lama glama
QVQLQESGGGLVQPGNSLRLSCAASGFTFRNFGMSWVRQAPGKEPEWVSSISGSGSNTIYADSVKDRFTISRDNAKSTLYLQMNSLKPEDTAVYYCTIGGSLSRSSQGTQVTVSSEPKTPKPQPAAAEVQLVESGGGLVQPGGSLRLSCAASGFTFSSHYMSWFRQAPGKEREFVAAITSSSRTYYTESVKGRFTISRDNAKNTVYLQMNSLKSEDTAVYYCAADRTFYGSTWSKYDYRGQGTQVTVSS

SEQ ID NO: 10883 - protein, 248 aa, Lama glama
QVQLQESGGGLVQPGGSLRLTCTASGFTFSSFGMSWVRQAPGKGLEWVSAISSDSGTKNYADSVKGRFTISRDNAKKMLFLQMNSLRPEDTAVYYCVIGRGSPSSQGTQVTVSSEPKTPKPQPAAAEVQLVESGGGLVQPGGSLRLSCAASGFTFSSHYMSWFRQAPGKEREFVAAITSSSRTYYTESVKGRFTISRDNAKNTVYLQMNSLKSEDTAVYYCAADRTFYGSTWSKYDYRGQGTQVTVSS

SEQ ID NO: 10884 - protein, 248 aa, Lama glama
QVQLQESGGGLVQPGGSLRLTCTASGFTFRSFGMSWVRQAPGKGLEWVSAISADGSDKRYADSVKGRFTISRDNGKKMLTLDMNSLKPEDTAVYYCVIGRGSPASQGTQVTVSSEPKTPKPQPAAAEVQLVESGGGLVQPGGSLRLSCAASGFTFSSHYMSWFRQAPGKEREFVAAITSSSRTYYTESVKGRFTISRDNAKNTVYLQMNSLKSEDTAVYYCAADRTFYGSTWSKYDYRGQGTQVTVSS

SEQ ID NO: 10885 - protein, 256 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQESGGGLVQAGGSLLLSCAASGRTFSSYAMGWFRQAPGKEREFVAAINWSGGSTSYADSVKGRFTISRDNTKNTVYLQMNSLKPEDTAAFYCAATYNPYSRDHYFPRMTTEYDYWGQGTQVTVSS

SEQ ID NO: 10886 - protein, 249 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQESGGRLVQTGGSLRLSCAASGGTFGTYALGWFRQAPGKEREFVAAISRFGSTYYADSVKGRFTISRDNANNTVYLEMNSLKPEDTAVYYCAAREGVALGLRNDANYWGQGTQVTVSS

SEQ ID NO: 10887 - protein, 248 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQDSGGGLVQAGGSLRLSCAASGGTFSSYAMGWFRQAPGKEREFVAAIGLNTYYADSVKGRFTISRDNAKNTVYLQMNSLKPEDTAVYYCAARTSGVVGGTPKRYDYWGQGTQVTVSS

SEQ ID NO: 10888 - protein, 249 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQESGGGSVQAGGSLKLSCAASGRGFSRYAMGWFRQAPGQDREFVATISWTNSTDYADSVKGRFAISRDNAKNTAYLQMNSLKPEDTAVYYCAADKWASSTRSIDYDYWGQGIQVTVSS

SEQ ID NO: 10889 - protein, 250 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQESGGGLVQAGGSLRLSCAASGRTFSNYAMGWFRQAPGKEREFVAAINWGGGNTYYADSVKGRFTISRDNAKNTVYLQMNSLKPEDTAVYYCAASEWGGSDYDHDYDYWGQGTQVTVSS

SEQ ID NO: 10890 - protein, 253 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVKLEESGGGLVQAGGSLRLSCAASGSIFSINAMGWYRQAPGKQRELVARITGTGTGITGAVSTNYADSVKGRFTISRDNARNTVYLQMNSLKPEDTAVYYCAADRSRTIVVPDYWGQGTQVTVSS

SEQ ID NO: 10891 - protein, 253 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQDSGGGLVQAGGSLRLSCAASRFSSAQYAIGWFRQAPGKEREGVSYITFSGGPTGYADSVKGRFTVSRDNAKNTVYLQMNSLKPEDTAVYYCAARPYTRPGSMWVSSLYDNWGQGTQVTVSS

SEQ ID NO: 10892 - protein, 250 aa, Lama glama
QVQLQESGGGLVQPGGSLRLSCEASGFTFSRFGMTWVRQAPGKGVEWVSGISSLGDSTLYADSVKGRFTISRDNAKNTLYLQMNSLKPEDTAVYYCTIGGSLNPGGQGTQVTVSSEPKTPKPQPAAAQVQLQESGGRLVQAGGSLRLSCAASEHTFRGYAIGWFRQAPGKEREFVSSITYDGTLTNYADSVTGRFTISRDNAKNTVYLQMNSLKPEDTAVYVCAAGYSYRYTTLNQYDSWGQGTQVTVSS

SEQ ID NO: 10893 - protein, 128 aa, Lama glama
AVQLVESGGGLVQAGDSLRLSCVVSGTTFSSAAMGWFRQAPGKEREFVGAIKWSGTSTYYTDSVKGRFTISRDNVKNTVYLQMNNLKPEDTGVYTCAADRDRYRDRMGPMTTTDFRFWGQGTQVTVSS

SEQ ID NO: 10894 - protein, 124 aa, Lama glama
QVKLEESGGGLVQTGGSLRLSCAASGRTFSSFAMGWFRQAPGREREFVASIGSSGITTNYADSVKGRFTISRDNAKNTVYLQMNSLKPEDTGLCYCAVNRYGIPYRSGTQYQNWGQGTQVTVSS

SEQ ID NO: 10895 - protein, 120 aa, Lama glama
EVQLEESGGGLVQPGGSLRLSCAASGLTFNDYAMGWYRQAPGKERDMVATISIGGRTYYADSVKGRFTISRDNAKNTVYLQMNSLKPEDTAIYYCVAHRQTVVRGPYLLWGQGTQVTVSS

SEQ ID NO: 10896 - protein, 123 aa, Lama glama
QVQLVESGGKLVQAGGSLRLSCAASGRTFSNYAMGWFRQAPGKEREFVAGSGRSNSYNYYSDSVKGRFTISRDNAKNTVYLQMNSLKPEDTAVYYCAASTNLWPRDRNLYAYWGQGTQVTVSS

SEQ ID NO: 10897 - protein, 125 aa, Lama glama
EVQLVESGGGLVQAGDSLRLSCAASGRSLGIYRMGWFRQVPGKEREFVAAISWSGGTTRYLDSVKGRFTISRDSTKNAVYLQMNSLKPEDTAVYYCAVDSSGRLYWTLSTSYDYWGQGTQVTVSS

SEQ ID NO: 10898 - protein, 125 aa, Lama glama
QVQLVEFGGGLVQAGDSLRLSCAASGRSLGIYKMAWFRQVPGKEREFVAAISWSGGTTRYIDSVKGRFTLSRDNTKNMVYLQMNSLKPDDTAVYYCAVDSSGRLYWTLSTSYDYWGQGTQVTVSS

SEQ ID NO: 10899 - protein, 124 aa, Lama glama
EVQLVESGGGLVQAGGSLSLSCAASGRTFSPYTMGWFRQAPGKEREFLAGVTWSGSSTFYGDSVKGRFTASRDSAKNTVTLEMNSLNPEDTAVYYCAAAYGGGLYRDPRSYDYWGRGTQVTVSS

SEQ ID NO: 10900 - protein, 131 aa, Lama glama
AVQLVESGGGLVQAGGSLRLSCAASGFTLDAWPIAWFRQAPGKEREGVSCIRDGTTYYADSVKGRFTISSDNANNTVYLQTNSLKPEDTAVYYCAAPSGPATGSSHTFGIYWNLRDDYDNWGQGTQVTVSS

SEQ ID NO: 10901 - protein, 126 aa, Lama glama
EVQLVESGGGLVQAGGSLRLSCAASGFTFDHYTIGWFRQVPGKEREGVSCISSSDGSTYYADSVKGRFTISSDNAKNTVYLQMNTLEPDDTAVYYCAAGGLLLRVEELQASDYDYWGQGIQVTVSS

SEQ ID NO: 10902 - protein, 128 aa, Lama glama
AVQLVDSGGGLVQPGGSLRLSCTASGFTLDYYAIGWFRQAPGKEREGVACISNSDGSTYYGDSVKGRFTISRDNAKTTVYLQMNSLKPEDTAVYYCATADRHYSASHHPFADFAFNSWGQGTQVTVSS

SEQ ID NO: 10903 - protein, 120 aa, Lama glama
EVQLVESGGGLVQAGGSLRLSCAAYGLTFWRAAMAWFRRAPGKERELVVARNWGDGSTRYADSVKGRFTISRDNAKNTVYLQMNSLKPEDTAVYYCAAVRTYGSATYDIWGQGTQVTVSS

SEQ ID NO: 10904 - protein, 123 aa, Lama glama
EVQLVESGGGLVQDGGSLRLSCIFSGRTFANYAMGWFRQAPGKEREFVAAINRNGGTTNYADALKGRFTISRDNTKNTAFLQMNSLKPDDTAVYYCAAREWPFSTIPSGWRYWGQGTQVTVSS

SEQ ID NO: 10905 - protein, 125 aa, Lama glama
DVQLVESGGGWVQPGGSLRLSCAASGPTASSHAIGWFRQAPGKEREFVVGINRGGVTRDYADSVKGRFAVSRDNVKNTVYLQMNRLKPEDSAIYICAARPEYSFTAMSKGDMDYWGKGTLVTVSS

SEQ ID NO: 10906 - protein, 118 aa, Mus musculus
EVQLQESGPSLVKPSQTLSLTCSVTGDSITSGYWNNWIRQFPGNKLEWMGYISYSGSTYYNPSLKSRISITRDTSKNQYFLQLNSVTTEDTATYYCARGGYGYGFDYWGQGTTVTVSS

SEQ ID NO: 10907 - protein, 330 aa, Homo sapiens [sequence omitted]

SEQ ID NO: 10908 - protein, 326 aa, Homo sapiens; identical to SEQ ID NO: 3049

SEQ ID NO: 10909 - protein, 377 aa, Homo sapiens; identical to SEQ ID NO: 5341

SEQ ID NO: 10910 - protein, 327 aa, Homo sapiens; identical to SEQ ID NO: 5342

SEQ ID NO: 10911 - protein, 330 aa, Artificial Sequence
  Description of Artificial Sequence: Synthetic polypeptide
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10912 - protein, 330 aa, Artificial Sequence; identical to SEQ ID NO: 10911
  Description of Artificial Sequence: Synthetic polypeptide
  Humanized antibody sequence

SEQ ID NO: 10913 - protein, 330 aa, Artificial Sequence; identical to SEQ ID NO: 10911
  Description of Artificial Sequence: Synthetic polypeptide
  Humanized antibody sequence

SEQ ID NO: 10914 - protein, 330 aa, Artificial Sequence; identical to SEQ ID NO: 10911
  Description of Artificial Sequence: Synthetic polypeptide
  Humanized antibody sequence

SEQ ID NO: 10915 - protein, 330 aa, Artificial Sequence; identical to SEQ ID NO: 10911
  Description of Artificial Sequence: Synthetic polypeptide
  Humanized antibody sequence

SEQ ID NO: 10916 - protein, 330 aa, Artificial Sequence; identical to SEQ ID NO: 10911
  Description of Artificial Sequence: Synthetic polypeptide
  Humanized antibody sequence

SEQ ID NO: 10917 - protein, 330 aa, Artificial Sequence; identical to SEQ ID NO: 10911
  Description of Artificial Sequence: Synthetic polypeptide
  Humanized antibody sequence

SEQ ID NO: 10918 - protein, 330 aa, Artificial Sequence; identical to SEQ ID NO: 10911
  Description of Artificial Sequence: Synthetic polypeptide
  Humanized antibody sequence

SEQ ID NO: 10919 - protein, 330 aa, Artificial Sequence; identical to SEQ ID NO: 10911
  Description of Artificial Sequence: Synthetic polypeptide
  Humanized antibody sequence

SEQ ID NO: 10920 - protein, 330 aa, Artificial Sequence; identical to SEQ ID NO: 10911
  Description of Artificial Sequence: Synthetic polypeptide
  Humanized antibody sequence

SEQ ID NO: 10921 - protein, 330 aa, Artificial Sequence; identical to SEQ ID NO: 10911
  Description of Artificial Sequence: Synthetic polypeptide
  Humanized antibody sequence

SEQ ID NO: 10922 - protein, 330 aa, Artificial Sequence; identical to SEQ ID NO: 10911
  Description of Artificial Sequence: Synthetic polypeptide
  Humanized antibody sequence

SEQ ID NO: 10923 - protein, 330 aa, Artificial Sequence; identical to SEQ ID NO: 10911
  Description of Artificial Sequence: Synthetic polypeptide
  Humanized antibody sequence

SEQ ID NO: 10924 - protein, 330 aa, Artificial Sequence; identical to SEQ ID NO: 10911
  Description of Artificial Sequence: Synthetic polypeptide
  Humanized antibody sequence

SEQ ID NO: 10925 - protein, 330 aa, Artificial Sequence; identical to SEQ ID NO: 10911
  Description of Artificial Sequence: Synthetic polypeptide
  Humanized antibody sequence

SEQ ID NO: 10926 - protein, 330 aa, Artificial Sequence; identical to SEQ ID NO: 10911
  Description of Artificial Sequence: Synthetic polypeptide
  Humanized antibody sequence

SEQ ID NO: 10927 - protein, 330 aa, Artificial Sequence; identical to SEQ ID NO: 10911
  Description of Artificial Sequence: Synthetic polypeptide
  Humanized antibody sequence

SEQ ID NO: 10928 - protein, 330 aa, Artificial Sequence; identical to SEQ ID NO: 10911
  Description of Artificial Sequence: Synthetic polypeptide
  Humanized antibody sequence

SEQ ID NO: 10929 - protein, 330 aa, Artificial Sequence; identical to SEQ ID NO: 10911
  Description of Artificial Sequence: Synthetic polypeptide
  Humanized antibody sequence

SEQ ID NO: 10930 - protein, 330 aa, Artificial Sequence; identical to SEQ ID NO: 10911
  Description of Artificial Sequence: Synthetic polypeptide
  Humanized antibody sequence

SEQ ID NO: 10931 - protein, 330 aa, Artificial Sequence; identical to SEQ ID NO: 10911
  Description of Artificial Sequence: Synthetic polypeptide
  Humanized antibody sequence

SEQ ID NO: 10932 - protein, 330 aa, Artificial Sequence; identical to SEQ ID NO: 10911
  Description of Artificial Sequence: Synthetic polypeptide
  Humanized antibody sequence

SEQ ID NO: 10933 - protein, 330 aa, Artificial Sequence; identical to SEQ ID NO: 10911
  Description of Artificial Sequence: Synthetic polypeptide
  Humanized antibody sequence

SEQ ID NO: 10934 - protein, 330 aa, Artificial Sequence; identical to SEQ ID NO: 10911
  Description of Artificial Sequence: Synthetic polypeptide
  Humanized antibody sequence

SEQ ID NO: 10935 - protein, 330 aa, Artificial Sequence; identical to SEQ ID NO: 10911
  Description of Artificial Sequence: Synthetic polypeptide
  Humanized antibody sequence

SEQ ID NO: 10936 - protein, 330 aa, Artificial Sequence; identical to SEQ ID NO: 10911
  Description of Artificial Sequence: Synthetic polypeptide
  Humanized antibody sequence

SEQ ID NO: 10937 - protein, 330 aa, Artificial Sequence
  Description of Artificial Sequence: Synthetic polypeptide
  Humanized antibody sequence
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10938 - protein, 110 aa, Homo sapiens
SGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10939 - protein, 108 aa, Homo sapiens
KGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10940 - protein, 330 aa, Artificial Sequence; identical to SEQ ID NO: 10911
  Description of Artificial Sequence: Synthetic polypeptide
  Gamma-1 constant domain

SEQ ID NO: 10941 - protein, 328 aa, Artificial Sequence
  Description of Artificial Sequence: Synthetic polypeptide
  Ig gamma-1 CH region
TKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10942 - protein, 119 aa, Artificial Sequence
  Description of Artificial Sequence: Synthetic polypeptide
  Recombinant Polypeptide
DKTHTCPPCPAPELLGGPSVFLFPPALEDLLLGSEANVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 10943 - protein, 120 aa, Artificial Sequence
  Description of Artificial Sequence: Synthetic polypeptide
  Recombinant Polypeptide
DKTHTCPPCPAPELLGGPSVFLFPPALEDLLLGSEANGVTCVVVDVSHEDPEVKFNWYVDGVEVHNAKTKPREEQYNSTYRVVSVLTVLHQDWLNGKEYKCKVSNKALPAPIEKTISKAK

SEQ ID NO: 10944 - protein, 233 aa, Homo sapiens
VPCPVPSTPPTPSPSTPPTPSPSCCHPRLSLHRPALEDLLLGSEANLTCTLTGLRDASGVTFTWTPSSGKSAVQGPPERDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDR

SEQ ID NO: 10945 - protein, 108 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 10946 - protein, 449 aa, Artificial Sequence
  Description of Artificial Sequence: Synthetic polypeptide
  Cetuximab A119 R216 heavy chain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10947 - protein, 330 aa, Artificial Sequence; identical to SEQ ID NO: 3050
  Description of Artificial Sequence: Synthetic polypeptide
  Cetuximab R216 heavy chain constant domain

SEQ ID NO: 10948 - protein, 333 aa, Artificial Sequence
  Description of Artificial Sequence: Synthetic polypeptide
  Cetuximab R216 Ins222PKS heavy chain constant domain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10949 - protein, 330 aa, Artificial Sequence [sequence omitted]

SEQ ID NO: 10950 - protein, 330 aa, Artificial Sequence; identical to SEQ ID NO: 3051
  Description of Artificial Sequence: Synthetic polypeptide
  Cetuximab R216 E358 M360 heavy chain constant domain

SEQ ID NO: 10951 - protein, 330 aa, Artificial Sequence [sequence omitted]

SEQ ID NO: 10952 - protein, 330 aa, Artificial Sequence; identical to SEQ ID NO: 5349
  Description of Artificial Sequence: Synthetic polypeptide

SEQ ID NO: 10953 - protein, 330 aa, Artificial Sequence; identical to SEQ ID NO: 3051
  Description of Artificial Sequence: Synthetic polypeptide
  synthetic anti-EphA3 antibody heavy chain constant region

SEQ ID NO: 10954 - protein, 330 aa, Homo sapiens [sequence omitted]

SEQ ID NO: 10955 - protein, 336 aa, Homo sapiens
LVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPAPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10956 - protein, 336 aa, Homo sapiens
LVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPDVFLFPPKPKDTLMISRTPEVTCVVVDVSHEDPEVKFNWYVDGVEVHNAKTKPREEQYNSTYRVVSVLTVLHQDWLNGKEYKCKVSNKALPLPEEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10957 - protein, 330 aa, Homo sapiens [sequence omitted]

SEQ ID NO: 10958 - protein, 326 aa, Homo sapiens; identical to SEQ ID NO: 3049

SEQ ID NO: 10959 - protein, 327 aa, Homo sapiens; identical to SEQ ID NO: 5342

SEQ ID NO: 10960 - protein, 376 aa, Homo sapiens
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPCPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPG

SEQ ID NO: 10961 - protein, 327 aa, Artificial Sequence; identical to SEQ ID NO: 5350
  Description of Artificial Sequence: Synthetic polypeptide

SEQ ID NO: 10962 - protein, 326 aa, Artificial Sequence; identical to SEQ ID NO: 3499
  Description of Artificial Sequence: Synthetic polypeptide

SEQ ID NO: 10963 - protein, 330 aa, Artificial Sequence; identical to SEQ ID NO: 3051
  Description of Artificial Sequence: Synthetic polypeptide

SEQ ID NO: 10964 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVAVSHEDPEVKFNWYVDGVEVHNAKTKPREEQYNSTYRVVSVLTVLHQDWLNGKEYKCKVSNKALAAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10965 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10966 - protein, 315 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 10967 - protein, 327 aa, Homo sapiens
  MOD_RES (189)..(189): Leu or Val
  MOD_RES (289)..(289): Arg or Lys
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVXHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSXLTVDKSRWQEGNVFSCSVMHEALHNHYTQKSLSLSLGK

SEQ ID NO: 10968 - protein, 330 aa, Artificial Sequence [sequence omitted]

SEQ ID NO: 10969 - protein, 327 aa, Homo sapiens; identical to SEQ ID NO: 5342

SEQ ID NO: 10970 - protein, 315 aa, Homo sapiens; identical to SEQ ID NO: 10966

SEQ ID NO: 10971 - protein, 256 aa, Artificial Sequence
  Description of Artificial Sequence: Synthetic polypeptide
  recombinant immunoglobulin
MKKNIAFLLASMFVFSIATNAYAEVQLVQSGGGLVQPGGSLRLSCAASGYSFSSHYMHWVRQAPGKGLEWVGYIDPSNGETTYNQKFKGRFTLSRDNSKNTAYLQMNSLRAEDTAVYYCARGDYRYNGDWFFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPP

SEQ ID NO: 10972 - protein, 231 aa, Artificial Sequence
  Description of Artificial Sequence: Synthetic polypeptide
  Chimeric (anti-alpha2-VH-IGHG1-CH1) heavy chain Fab fragment
QVQLHQPGAELVKPGAPVKLSCKASGYTFTSYWMNWVKQRPGRGLEWIGRIDPSDSETHYNQKFKDKATLTVDKSSSTAYIQLSSLTSEDSAVYYCAKVGRGYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTHHHHHH

SEQ ID NO: 10973 - protein, 128 aa, Artificial Sequence
  Description of Artificial Sequence: Synthetic polypeptide
  Synthetic gamma heavy chain consensus sequence
  MOD_RES (16)..(16): Any amino acid
  MOD_RES (31)..(32): Any amino acid
  MOD_RES (42)..(42): Any amino acid
  MOD_RES (58)..(58): Any amino acid
  MOD_RES (102)..(112): Any amino acid
  MOD_RES (114)..(114): Any amino acid
  MOD_RES (116)..(116): Any amino acid
QVQLQESGPGLVKPSXTLSLTCTVSGGSISXXGYYWSWIRQXPGKGLEWIGYIYYSGXSTYYNPSLKSRVTISVDTSKNQFSLKLSSVTAADTAVYYCARDXXXXXXXXXXXYXGXFDVWGQGTLVTV

SEQ ID NO: 10974 - protein, 118 aa, Artificial Sequence
  Description of Artificial Sequence: Synthetic polypeptide
  Synthetic gamma heavy chain protein sequence
QVQLVQSGAEVKKPGASVKVSCKASGYTFTGYYIHWVRQAPGQGLEWMGWINPNSGGTNYAQKFQGRVTMTRDTSISTAYMELSRLRSDDTAVYYCARELELRYYGMDVWGQGTTVTV

SEQ ID NO: 10975 - protein, 118 aa, Artificial Sequence
  Description of Artificial Sequence: Synthetic polypeptide
  Synthetic gamma heavy chain protein sequence
QVQLVQSGAEVKKPGASVKVSCKASGYTFTGYYINWVRQAPGQGLEWMGWINPNSGGTNYAQKFQGRVTMTRDTSITTAYMELSRLRADDTAVYYCARELELRYYGMDVWGQGTTVTV

SEQ ID NO: 10976 - protein, 120 aa, Artificial Sequence
  Description of Artificial Sequence: Synthetic polypeptide
  Synthetic gamma heavy chain protein sequence
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDEYNSGWYVLFDYWGQGTLVTV

SEQ ID NO: 10977 - protein, 116 aa, Artificial Sequence
  Description of Artificial Sequence: Synthetic polypeptide
  Synthetic gamma heavy chain protein sequence
QVQLVESGGGVVQPGRSLRLSCAASGFTFSSYGMHWVRQAPGKGLEWVAVIWYDGSDKYYADSVKGRFTISRDNSKNTLYLQMNSLRAEDTAVYYCAREDYGEGFDYWGQGTLVTV

SEQ ID NO: 10978 - protein, 127 aa, Artificial Sequence
  Description of Artificial Sequence: Synthetic polypeptide
  Synthetic gamma heavy chain protein sequence
QVQLQESGPGLVKPSQTLSLTCTVSGGSISSDGYYWSWIRQHPGKGLEWIGYIYYSGSTYYNPSLKSRVTISVDTSKNQFSLKLSSVTAADTAVYYCARSHLHYYDSSGYYYGGAFDIWGQGTMVTV

SEQ ID NO: 10979 - protein, 119 aa, Artificial Sequence
  Description of Artificial Sequence: Synthetic polypeptide
  Synthetic gamma heavy chain protein sequence
QVQLQESGPGLVKPSQTLSLTCTVSGGSISSGGYYWSWIRQHPGKGLEWIGNIYYSGITYYNPSLKSRVTMSVDTSKNQFSLKLSSVTAADTAVYYCARDPLYGDYGFDPWGQGTLVTV

SEQ ID NO: 10980 - protein, 123 aa, Artificial Sequence
  Description of Artificial Sequence: Synthetic polypeptide
  Synthetic gamma heavy chain protein sequence
QVQLQESGPGLVKPSQTLSLTCTVSGGSISSGGYYWSWIRQHPGKGLEWIGYIYYSGSTYYNPSLKSRVTISVDTSKNQFSLKVSSVTAADTAVYYCARDPLWFGEFDYYGMDVWGQGTTVTV

SEQ ID NO: 10981 - protein, 121 aa, Artificial Sequence
  Description of Artificial Sequence: Synthetic polypeptide
  Synthetic gamma heavy chain protein sequence
QVQLKESGPGLVKPSQTLSLTCTVSGGSISSGVYYWSWIRQHPGKGLEWIGYFYYSGNTYHNPSLKSRVTISVDTSKNQFSLKLSSVTAADTAVYYCARDRSGYDHPDAFDIWGQGTMVTV

SEQ ID NO: 10982 - protein, 118 aa, Artificial Sequence
  Description of Artificial Sequence: Synthetic polypeptide
  Synthetic gamma heavy chain protein sequence
QVQLQQWGAGLLKPSETLSLTCAVYGGSFSTYYWSWIRQPPGKGLEWIGEINHSGSTNYNPSLKSRVTISVDTSKNQFSLKLSSVTAADTAVYYCARGGYDFWSGYYDYWGQGTLVTV

SEQ ID NO: 10983 - protein, 116 aa, Artificial Sequence
  Description of Artificial Sequence: Synthetic polypeptide
  Synthetic gamma heavy chain protein sequence
QVQLQESGPGLVKPSETLSLTCTVSGGSISIYYWSWIRQPPGKGLEWIGYVYYSGSTNYNPSLKSRVTISVDTSKNQFSLKLNSVTAADTAVYYCARGGYDFWSGYFDYWGQGTLV

SEQ ID NO: 10984 - protein, 124 aa, Artificial Sequence
  Description of Artificial Sequence: Synthetic polypeptide
QVQLQQSGAELVKPGASVKLSCKASGYTFTSYWMHWVKQRPGQGLEWIGEINPSNGRTNYNEKFKRKATLTVDKSSSTAYMQLSSLTSEDSAVYYFARGRPDYYGSSKWYFDVWGAGTTVTVSS

SEQ ID NO: 10985 - protein, 120 aa, Artificial Sequence
  Description of Artificial Sequence: Synthetic polypeptide
  synthetic antibody structure
QVQLQQPGSVLVRPGASVKLSCKASGYTFTSSWIHWAKQRPGQGLEWIGEIHPNSGNTNYNEKFKGKATLTVDTSSSTAYVDLSSLTSEDSAVYYCARWRYGSPYYFDYWGQGTTLTVSS

SEQ ID NO: 10986 - protein, 117 aa, Artificial Sequence
  Description of Artificial Sequence: Synthetic polypeptide
QIQLQQSGPELVRPGASVKISCKASGYTFTDYYIHWVKQRPGEGLEWIGWIYPGSGNTKYNEKFKGKATLTVDTSSSTAYMQLSSLTSEDSAVYFCARGGKFAMDYWGQGTSVTVSS

SEQ ID NO: 10987 - protein, 120 aa, Artificial Sequence
  Description of Artificial Sequence: Synthetic polypeptide
QIQLQQSGPELVKPGASVKISCKASGYTFTDYYINWMKQKPGQGLEWIGWIDPGSGNTKYNEKFKGKATLTVDTSSSTAYMQLSSLTSEDTAVYFCAREKTTYYYAMDYWGQGTSVTVSA

SEQ ID NO: 10988 - protein, 120 aa, Artificial Sequence
  Description of Artificial Sequence: Synthetic polypeptide
  synthetic antibody structure
QVQLLESGAELMKPGASVKISCKATGYTFSSFWIEWVKQRPGHGLEWIGEILPGSGGTHYNEKFKGKATFTADKSSNTAYMQLSSLTSEDSAVYYCARGHSYYFYDGDYWGQGTSVTVSS

SEQ ID NO: 10989 - protein, 120 aa, Artificial Sequence
  Description of Artificial Sequence: Synthetic polypeptide
QVQLQQSGAELVKPGASVKLSCKASGYTFTSYWMHWVKQRPGRGLEWIGRIDPNSGGTKYNEKFKSKATLTVDKPSSTAYMQLSSLTSEDSAVYYCARYDYYGSSYFDYWGQGTTVTVSS

SEQ ID NO: 10990 - protein, 120 aa, Artificial Sequence
  Description of Artificial Sequence: Synthetic polypeptide
  synthetic antibody structure
QVQLQQPGAELVKPGASVKLSCKASGYTFTSYWMHWVKQRPGRGLEWIGRIDPNSGGTKYNEKFKSKATLTVDKPSSTAYMQLSSLTSEDSAVYYCARYDYYGSSYFDYWGQGTTLTVSS

SEQ ID NO: 10991 - protein, 120 aa, Artificial Sequence
  Description of Artificial Sequence: Synthetic polypeptide
QVQLQQSGAELMKPGASVKISCKATGYTFSSFWIEWVKQRPGHGLEWIGEILPGSGGTHYNEKFKGKATFTADKSSNTAYMQLSSLTSEDSAVYYCARGHSYYFYDGDYWGQGTSVTVSS

SEQ ID NO: 10992 - protein, 447 aa, Artificial Sequence
  Description of Artificial Sequence: Synthetic polypeptide
  humanized immunoglobulin
QVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 10993 - protein, 473 aa, Artificial Sequence
  Description of Artificial Sequence: Synthetic polypeptide
  heavy chain immunoglobulin
MEFGLSWVFLVAIIKGVQCQVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARVLRFLEWLLYYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10994 - protein, 470 aa, Artificial Sequence
  Description of Artificial Sequence: Synthetic polypeptide
  heavy chain immunoglobulin
MEFGLSWVFLVAIIKGVQCQAQLVESGGGLVKPGGSLRLSCAASGFTFSDYYMSWIRQAPGKGLEWVSYISSSGSTRDYADSVKGRFTISRDNAKNSLYLQMNSLRAEDTAVYYCVRDGVETTFYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10995 - protein, 470 aa, Artificial Sequence
  Description of Artificial Sequence: Synthetic polypeptide
  heavy chain immunoglobulin
MEFGLSWLFLVAILKGVQCEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKGYSSGWYYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10996 - protein, 470 aa, Artificial Sequence
  Description of Artificial Sequence: Synthetic polypeptide
  heavy chain immunoglobulin
MEFGLSWLFLVAILKGVQCEVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 10997 - protein, 143 aa, Mus musculus
MGWSYIILFLVATATEVHSQVQLQQSGAELVKPGASVKLSCKASGYTFTSYWMHWVKQRPGQGLEWIGEINPSNGRTNYNEKFKRKATLTVDKSSSTAYMQLSSLTSEDSAVYYFARGRPDYYGSSKWYFDVWGAGTTVTVSS

SEQ ID NO: 10998 - protein, 120 aa, Artificial Sequence
  Description of Artificial Sequence: Synthetic polypeptide
  L2G7 heavy chain
QVQLQQSGADLMKPGASVKISCKATGYTFSGNWIEWVKQRPGHGLEWIGEILPGSGNTNYNEKFKGKATFTADTSSNTAYMQLSSLTSEDSAVYYCARGGHYYGSSWDYWGQGTTLTVSS

SEQ ID NO: 10999 - protein, 123 aa, Homo sapiens
VQLLESGGGLVQPGGSLRLSCTASGFTFSSYAMNWVRQAPGKGLEWVSAISGSGGTTFYADSVKGRFTISRDNSRTTYLQMNSLRAEDTAVYYCAKDLGWSDSYYYYYGMDVWGQGTTVTVSS

SEQ ID NO: 11000 - protein, 120 aa, Artificial Sequence
  Description of Artificial Sequence: Synthetic polypeptide
  HuL2G7 heavy chain variable region
EVQLVQSGAEVKKPGASVKVSCKVSGYTFSGNWIEWVRQAPGKGLEWIGEILPGSGNTNYNEKFKGKATMTADTSTDTAYMELSSLRSEDTAVYYCARGGHYYGSSWDYWGQGTLVTVSS

SEQ ID NO: 11001 - protein, 125 aa, Artificial Sequence
  Description of Artificial Sequence: Synthetic polypeptide
  AAC18323 heavy chain variable region
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATPVGRCSSTSCYHPLDYWGQGTLVTVSS

SEQ ID NO: 11002 - protein, 461 aa, Artificial Sequence
  Description of Artificial Sequence: Synthetic polypeptide
  polypeptide consisting of heavy chain of huAbF46-H4-A1, human IgG2 hinge and constant region of human IgG1
  1-17: signal peptide
MEWSWVFLVTLLNGIQCEVQLVESGGGLVQPGGSLRLSCAASGFTFTDYYMSWVRQAPGKGLEWLGFIRNKANGYTTEYSASVKGRFTISRDNSKNTLYLQMNSLRAEDTAVYYCARDNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVERKCCVECPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11003 - protein, 460 aa, Artificial Sequence
  Description of Artificial Sequence: Synthetic polypeptide
  polypeptide consisting of heavy chain of huAbF46-H4-A1, human IgG2 hinge and constant region of human IgG2
  1-17: signal peptide
MEWSWVFLVTLLNGIQCEVQLVESGGGLVQPGGSLRLSCAASGFTFTDYYMSWVRQAPGKGLEWLGFIRNKANGYTTEYSASVKGRFTISRDNSKNTLYLQMNSLRAEDTAVYYCARDNWFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 11004 - protein, 462 aa, Artificial Sequence
  Description of Artificial Sequence: Synthetic polypeptide
  polypeptide consisting of heavy chain of huAbF46-H4-A1, U6-HC7  hinge and constant region of human IgG1
  1-17: signal peptide
MEWSWVFLVTLLNGIQCEVQLVESGGGLVQPGGSLRLSCAASGFTFTDYYMSWVRQAPGKGLEWLGFIRNKANGYTTEYSASVKGRFTISRDNSKNTLYLQMNSLRAEDTAVYYCARDNWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDCHCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11005 - protein, 119 aa, Artificial Sequence
  Description of Artificial Sequence: Synthetic polypeptide
  DP-h1, 2, 4, 5, 6, 8 heavy chain protein
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDDEFAYWGPGTLVTVSA

SEQ ID NO: 11006 - protein, 119 aa, Artificial Sequence
  Description of Artificial Sequence: Synthetic polypeptide
  DP-h3, 7 heavy chain protein
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDDEFAYWGPGTLVTVSA

SEQ ID NO: 11007 - protein, 119 aa, Artificial Sequence
  Description of Artificial Sequence: Synthetic polypeptide
  DP-h9, 12, 14 heavy chain protein
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDDEFAYWGPGTLVTVSA

SEQ ID NO: 11008 - protein, 119 aa, Artificial Sequence
  Description of Artificial Sequence: Synthetic polypeptide
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDDEFAYWGPGTLVTVSA

SEQ ID NO: 11009 - protein, 119 aa, Artificial Sequence
  Description of Artificial Sequence: Synthetic polypeptide
  FDP-h2 heavy chain protein
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDDEFAYWGPGTLVTVSA

SEQ ID NO: 11010 - protein, 119 aa, Artificial Sequence
  Description of Artificial Sequence: Synthetic polypeptide
  FDP-h3, 7, 11, 15 heavy chain protein
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDDEFAYWGPGTLVTVSA

SEQ ID NO: 11011 - protein, 119 aa, Artificial Sequence
  Description of Artificial Sequence: Synthetic polypeptide
  FDP-h4, 8, 12, 16 heavy chain protein
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDDEFAYWGPGTLVTVSA

SEQ ID NO: 11012 - protein, 119 aa, Artificial Sequence
  Description of Artificial Sequence: Synthetic polypeptide
  FDP-h6 heavy chain protein
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDDEFAYWGPGTLVTVSA

SEQ ID NO: 11013 - protein, 119 aa, Artificial Sequence
  Description of Artificial Sequence: Synthetic polypeptide
  FDP-h10, 14, 18 heavy chain protein
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDDEFAYWGPGTLVTVSA

SEQ ID NO: 11014 - protein, 97 aa, Homo sapiens; identical to SEQ ID NO: 5092

SEQ ID NO: 11015 - protein, 97 aa, Homo sapiens; identical to SEQ ID NO: 5093

SEQ ID NO: 11016 - protein, 98 aa, Homo sapiens; identical to SEQ ID NO: 5094

SEQ ID NO: 11017 - protein, 122 aa, Artificial Sequence
  Description of Artificial Sequence: Synthetic polypeptide
  A12 heavy chain variable domain sequence
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKSSSSWYRSYYFDYWGQGTLVTVSS

SEQ ID NO: 11018 - protein, 121 aa, Artificial Sequence
  Description of Artificial Sequence: Synthetic polypeptide
  C2 heavy chain variable domain
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCASQHVGEQSRYFDYWGQGTLVTVSS

SEQ ID NO: 11019 - protein, 117 aa, Artificial Sequence
  Description of Artificial Sequence: Synthetic polypeptide
  E9 heavy chain variable domain sequence
QVQLQESGGGVVQPGRSLRLSCAASGFTFSSYGMHWVRQAPGKGLEWVSAIGSSGGSTHDADTVKGRFTISRDNAKNSLYLQMNSLRAEDTAVYYCARDRARGFDYWGQGTLVTVSS

SEQ ID NO: 11020 - protein, 115 aa, Artificial Sequence
  Description of Artificial Sequence: Synthetic polypeptide
  F1 heavy chain variable domain sequence
QVQLVQSGAEVKKPGASVKVSCKASGYTFTDYYMHWVRQAPGEGLEWMGWMNPNSGGTNYAQKFQGRVTMTRDTSISTAYMELSRLRSDDTAVYYCARSHYWDSWSPGTLVTVSS

SEQ ID NO: 11021 - protein, 116 aa, Artificial Sequence
  Description of Artificial Sequence: Synthetic polypeptide
  F11 heavy chain variable domain sequence
QVQLQESGGGLLQPGGSLRLSCAASRFTFSNYAMSWVRQAPGKGLEWVSAISGSGASTYYADSVKGRFTISRDNSKNTLYLQMNSLRAEDTAVYYCSNLYGDYDYWGQGTLVTVSS

SEQ ID NO: 11022 - protein, 128 aa, Artificial Sequence
  Description of Artificial Sequence: Synthetic polypeptide
  G1 heavy chain variable domain sequence
QVQLQESGGGVVQPGGSLRLSCAASGFTFSSYSMNWVRQAPGKGLEWVSSISSSSSYIYYADSVKGRFTISRDNAKNSLYLQMNSLRAEDTAVYYCARDLPSDDYGDYDYYYYGMDVWGQGTTVTVSS

SEQ ID NO: 11023 - protein, 120 aa, Artificial Sequence
  Description of Artificial Sequence: Synthetic polypeptide
  H2 heavy chain variable domain sequence
EVQLVESGGGLVQPGGSLRLSCAASGFTFSTYAMSWVRQAPGKGLEWVSAISGSGGSTYYADSVKGRFTISRDNSKNTLYLQMNSLRAEDTAVYYCAREGGKWYYGMDVWGRGTLVTVSS

SEQ ID NO: 11024 - protein, 117 aa, Artificial Sequence
  Description of Artificial Sequence: Synthetic polypeptide
  H5 heavy chain variable domain sequence
QVQLQESGGGLVQPGGSLRLSCAASGFTFSNYAMSWVRQAPGKGLEWVSAISGSGGSTYYADSVKGRFTISRDNSKNTLYLQMNSLRAEDTAVYYCAKDRFRAAAYWGQGTLVTVSS

SEQ ID NO: 11025 - protein, 108 aa, Artificial Sequence
  Description of Artificial Sequence: Synthetic polypeptide
  Variable chain of single chain antibody
QSVLTQDPAVSVALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 11026 - protein, 108 aa, Artificial Sequence
  Description of Artificial Sequence: Synthetic polypeptide
  Variable chain of single chain antibody
QSVLTQDPAVSVALGQTVKITCQGDSLRSYFASWYQQKPGQAPTLVMYARNDRPAGVPDRFSGSKSGTSASLAISGLQPEDEADYYCAAWDDSLNGYLFGAGTKLTVL

SEQ ID NO: 11027 - protein, 108 aa, Artificial Sequence
  Description of Artificial Sequence: Synthetic polypeptide
  Variable chain of single chain antibody
QSVLTQDPAASVALGQTVKITCQGDSLRSYFASWYQQKPGQAPTLVMYARNDRPAGVPDRFSGSKSGTSASLAISGLQSEDEADYYCAAWDDSLNGYLFGAGTKLTVL

SEQ ID NO: 11028 - protein, 108 aa, Artificial Sequence
  Description of Artificial Sequence: Synthetic polypeptide
  Variable chain of single chain antibody
QSVLTQDPAVSVALGQTVKITCQGDSLRSYLASWYQQKPGQAPTLVTYARNDRPAGVPDRFSGSKSGTSASLAISGLQSEDEADYYCAAWDDSLNGYLFGAGTKLTVL

SEQ ID NO: 11029 - protein, 119 aa, Mus sp.
  MOD_RES (49)..(49): Any amino acid
  MOD_RES (54)..(54): Any amino acid
  MOD_RES (107)..(107): Any amino acid
EVQLVQSGAEVKKPGESLKISCKGSGYSFTSYWIGWVRQMPGKGLEWMXIIYPXDSDTRYSPSFQGQVTISADKSISTAYLQWSSLKASDTAMYYCARGIIYPSNVXVWGQGTLVTVSS

SEQ ID NO: 11030 - protein, 121 aa, Mus sp.
QVQLQQPGSELVRPGASVQLSCKASGYSFTSYWMHWVRQRPGQGLQWIGNIYPGTGNTNYDEKFMNKATLTVDTYSSTTYMQLSSLTSEDSAVYYCARWGLVRYFFAMDYWGQGTSVTVSS

SEQ ID NO: 11031 - protein, 118 aa, Mus sp.
EVQLQQSGPELVKPGASMKISCRASGYSFTGYTMNWVRQSHGKNLEWIGLINPHNGGSSYNLKFKGKATLTVDKSSSTAYMELLSLTSEDSAVYYCVRWGDYGSFAYWGQGTLVTVSA

SEQ ID NO: 11032 - protein, 119 aa, Mus sp.
EVQLQQSGPELVKPGASVKISCKASGYSFTAYYMHWVKQSHVKSLEWIGLVNPYNGFSSYNQNFEDKASLTVDKFSSTAYMELHSLTSEDSAVYYCAREFYGYRYFDVWGAGTAVTVSS

SEQ ID NO: 11033 - protein, 121 aa, Artificial Sequence
  Description of Artificial Sequence: Synthetic polypeptide
  Synthetic Construct
QVQLVQPGAEVVKPGASVKLSCKASGYNFTSYWMHWVRQRPGQGLQWIGNIYPGTGNTNYDQKFQGKATLTVDTSTSTTYMQLSSLTSEDSAVYYCARWGLVRYFFAMDYWGQGTSVTVSS

SEQ ID NO: 11034 - protein, 121 aa, Artificial Sequence
  Description of Artificial Sequence: Synthetic polypeptide
  Synthetic Construct
QVQLVQPGAEVVKPGASVKLSCKASGYSFTSYWMHWVRQRPGQGLQWIGNIYPGTGNTNYDQKFQGKATLTVDTSTSTTYMQLSSLTSEDSAVYYCARWGLVRYFFAMDYWGQGTSVTVSS

SEQ ID NO: 11035 - protein, 121 aa, Artificial Sequence
  Description of Artificial Sequence: Synthetic polypeptide
  Synthetic Construct
QVQLVQPGAEVVKPGASVKLSCKASGYNFTSYWMHWVRQRPGQGLQWIGNIYPGTGNTNYDQKFQGKATLTVDTYTSTTYMQLSSLTSEDSAVYYCARWGLVRYFFAMDYWGQGTSVTVSS

SEQ ID NO: 11036 - protein, 118 aa, Artificial Sequence
  Description of Artificial Sequence: Synthetic polypeptide
  Humanized antibody
EVQLLQSGGELVQPGASMRISCAASGYTFTGYTMNWVRQSPGKNLEWIGLINPHNGGSSYNDSFKGKATLTVDKSSSTAYMELLSLTAEDSAVYYCVRWGDYGSFAYWGQGTLVTVSS

SEQ ID NO: 11037 - protein, 118 aa, Artificial Sequence
  Description of Artificial Sequence: Synthetic polypeptide
  Humanized antibody
EVQLLQSGGELVQPGASMRISCAASGYSFTGYTMNWVRQSPGKNLEWIGLINPHNGGSSYNDSFKGKATLTVDKSSSTAYMELLSLTAEDSAVYYCVRWGDYGSFAYWGQGTLVTVSS

SEQ ID NO: 11038 - protein, 119 aa, Artificial Sequence
  Description of Artificial Sequence: Synthetic polypeptide
  Synthetic Construct
QVQLVQSGAEVVKPGASVKISCKASGYTFTAYYMHWVKQSPVQSLEWIGLVNPYNGFSSYNQKFQGKASLTVDKSSSTAYMELHSLTSEDSAVYYCAREFYGYRYFDVWGQGTAVTVSS

SEQ ID NO: 11039 - protein, 119 aa, Artificial Sequence
  Description of Artificial Sequence: Synthetic polypeptide
  Synthetic Construct
QVQLVQSGAEVVKPGASVKISCKASGYSFTAYYMHWVKQSPVQSLEWIGLVNPYNGFSSYNQKFQGKASLTVDKSSSTAYMELHSLTSEDSAVYYCAREFYGYRYFDVWGQGTAVTVSS

SEQ ID NO: 11040 - protein, 119 aa, Artificial Sequence
  Description of Artificial Sequence: Synthetic polypeptide
  Humanized antibody
QVQLVQSGAEVVKPGASVKISCKASGYTFTAYYMHWVKQSPGQSLEWIGLVNPYNGFSSYNQKFQGKASLTVDKSSSTAYMELHSLTSEDSAVYYCAREFYGYRYFDVWGQGTAVTVSS

SEQ ID NO: 11041 - protein, 119 aa, Artificial Sequence
  Description of Artificial Sequence: Synthetic polypeptide
  Synthetic Construct
QVQLVQSGAEVVKPGASVKISCKASGYSFTAYYMHWVKQSPGQSLEWIGLVNPYNGFSSYNQKFQGKASLTVDKSSSTAYMELHSLTSEDSAVYYCAREFYGYRYFDVWGQGTAVTVSS

SEQ ID NO: 11042 - protein, 120 aa, Mus sp.
EVQLQQSGPDLVKPGASVKISCKASGYRFTEYNMHWMKQSHGESLEWIGYIYPYNGDTGYRQKFKNMATLTADISSNTAYMELRSLTSDDSAVYFCARWGYGSGGGFTYWGQGTLVTVSA

SEQ ID NO: 11043 - protein, 119 aa, Mus sp.
EVQLQQSGPELVKPGASVKISCKASGYTFTDYNMHWVKQSHGKSLEWIGFIYPYNGGTGYNQRFKNKATLTVDTSSSTAYMEVRSLTSEDSAVYFCARGYYYGRHFDYWGQGTTLTVSS

SEQ ID NO: 11044 - protein, 123 aa, Mus musculus
EVQLQQSGPELVKPGASVRISCKASGYAFTDYYMNWVKQSHGKSLEWVANINPNNGGTNYNQKFKDKATLTVDKSSNTAYMELRSLTSEDTAVYYCARWILYYGRSKWYFDVWGTGTTVTVSS

SEQ ID NO: 11045 - protein, 122 aa, Mus musculus
QVQLKQSGPGLVQSSQSLSITCTISGFSLTSHGIYWLRQSPGKGLEWLGVIWSGGSADYNAAFISRLSISKDNSKSQVFFKMNSLQADDTAIYYCARSPYYYRSSLYAMDYWGQGTSVTVSS

SEQ ID NO: 11046 - protein, 123 aa, Artificial Sequence
  Description of Artificial Sequence: Synthetic polypeptide
  Chimeric variable heavy chain comprising sequences from mus musculus and homo sapiens
EVQLQQSGPELVKPGASVRISCKASGYAFTDYYMNWVKQSHGKSLEWVANINPNNGGTNYNQKFKDKATLTVDKSSNTAYMELRSLTSEDTAVYYCARWILYYGRSKWYFDVWGTGTLVTVSS

SEQ ID NO: 11047 - protein, 123 aa, Homo sapiens
QVQLVQSGAEVKKPGASVKVSCKASGYTFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSS

SEQ ID NO: 11048 - protein, 123 aa, Homo sapiens
QVQLVQSGAEVKKPGASVKVSCKASGYAFTDYYMNWVRQAPGQGLEWMGNINPNNGGTNYNQKFKDRVTMTTDTSTSTAYMELRSLRSDDTAVYYCARWILYYGRSKWYFDVWGRGTLVTVSS

SEQ ID NO: 11049 - protein, 123 aa, Mus musculus
EVQLQQSGPELVKPGASVRISCKASGYAFTDYYMNWVKQSHGKSLEWMANINPNNGGTNYNQKFKDKATLTVDKSSNTAYMELRSLTSEDSAVYYCARWILYYGRSKWYFDVWGPGTTVTVSS

SEQ ID NO: 11050 - protein, 123 aa, Mus musculus
EVQLQQSGPELVKPGASVKISCKASGYAFTDYYMNWVKQTHGRSLEWMANINPNTGGTNYNQKFRGKATLTVDKSSTTAYMELRSLTSEDSAVYYCARWILYYGSSRWYFDVWGTGTTVTVSS

SEQ ID NO: 11051 - protein, 123 aa, Mus musculus
EVQLQQSGPELVKPGASVKISCKASGYAFTDYYMNWVKQSHGKSLEWMANINPNTGGTNYNQKFTGKATLTVDKSSTTAYMELRSLTSEDSAVYYCTRWILYYGSSKWYFDVWGTGTTVTVSS

SEQ ID NO: 11052 - protein, 117 aa, Artificial Sequence
  Description of Artificial Sequence: Synthetic polypeptide
QVQLHQPGAELVKPGAPVKLSCKASGYTFTSYWMNWVKQRPGQGLEWIGRIDPSDSETHYNQKFKDRATLTVDKSSSTAYIQLSSLTSEDSAVYYCAKVGRGYFDYWGQGTTLTVVS

SEQ ID NO: 11053 - protein, 117 aa, Artificial Sequence
  Description of Artificial Sequence: Synthetic polypeptide
QVQLHQPGAELVKPGAPVKLSCKASGYTFTSYWMNWVKQRPGQGLEWIGRIDPSESETHYNQKFKDRATLTVDKSSSTAYIQLSSLTSEDSAVYYCAKVGRGYFDYWGQGTTLTVVS

SEQ ID NO: 11054 - protein, 117 aa, Artificial Sequence
  Description of Artificial Sequence: Synthetic polypeptide
QVQLHQPGAELVKPGASVKLSCKASGYTFTSYWMNWVKQRPGRGLEWIGRIDPSDSETHYNQKFKDKATLTVDKSSSTAYIQLSSLTSEDSAVYYCAKVGRGYFDYWGQGTTLTVVS

SEQ ID NO: 11055 - protein, 117 aa, Artificial Sequence
  Description of Artificial Sequence: Synthetic polypeptide
QVQLHQPGAELVKPGASVKLSCKASGYTFTSYWMNWVKQRPGRGLEWIGRIDPSDSETHYNQKFKDKATLTVDKSSSTAYIQLSSLTSEDSAKYYCAKVGRGYFDYWGQGTTLTVVS

SEQ ID NO: 11056 - protein, 117 aa, Artificial Sequence
  Description of Artificial Sequence: Synthetic polypeptide
QVQLHQPGAELVKPGASVKLSCKASGYTFTSYWMNWVKQRPGRGLEWIGRIDPSESETHYNQKFKDKATLTVDKSSSTAYIQLSSLTSEDSAVYYCAKVGRGYFDYWGQGTTLTVVS

SEQ ID NO: 11057 - protein, 117 aa, Artificial Sequence
  Description of Artificial Sequence: Synthetic polypeptide
QVQLHQPGAELVKPGASVKLSCKASGYTFTSYWMNWVKQRPGRGLEWIGRIDPSESETHYNQKFKDKATLTVDKSSSTAYIQLSSLTSEDSAKYYCAKVGRGYFDYWGQGTTLTVVS

SEQ ID NO: 11058 - protein, 117 aa, Artificial Sequence
  Description of Artificial Sequence: Synthetic polypeptide
QVQLVQSGAEVKKPGASVKVSCKASGYTFTSYWMNWVRQAPGQGLEWIGRIDPSDSETHYAQKFQGRATLTVDKSTSTAYMELSSLRSEDTAVYYCAKVGRGYFDYWGQGTLVTVSS

SEQ ID NO: 11059 - protein, 117 aa, Artificial Sequence
  Description of Artificial Sequence: Synthetic polypeptide
QVQLHQPGAELVKPGAPVKLSCKASGYTFTSYWMNWVKQRPGRGLEWIGRIDPSDSETHYNQKFKDKATLTVDKSSSTAYIQLSSLTSEDSAVYYCAKVGRGYFDYWGQGTTLTVSS

SEQ ID NO: 11060 - protein, 117 aa, Mus musculus
EIQLQQSGPELMKPGASVKISCKASGYSFSSHYMHWVKQSHGKSLEWIGYIDPSNGETTYNQKFKGKATLTVDTSSSTANVHLSSLTSDDSAVYFCAARGDYRYNGDWFFDVWGAGT

SEQ ID NO: 11061 - protein, 121 aa, Homo sapiens
EVQLVESGGGLVQPGGSLRLSCAASGFSLSGSWIHWVRQAPGKGLEWVGWINPYRGYAYYADSVKGRFTISADTSKNTAYLQMNSLRAEDTAVYYCAREYSGWGGSSVGYAMDYWGQGTLV

SEQ ID NO: 11062 - protein, 121 aa, Homo sapiens
EVQLVESGGGLVQPGGSLRLSCAASGFSFTGTWIHWVRQAPGKGLEWVGWIAPYSRHPYYADSVKGRFTISADTSKNTAYLQMNSLRAEDTAVYYCAREYSGWGGSSVGYAMDYWGQGTLV

SEQ ID NO: 11063 - protein, 115 aa, Homo sapiens
EVQLVESGGGLVQPGGSLRLSCAASGFTFTGTGIHWVRQAPGKGLEWVAGIPPVGSYTYYADSVKGRFTISADTSKNTAYLQMNSLRAEDTAVYYCARWRSLSSGMDYWGQGTLV

SEQ ID NO: 11064 - protein, 115 aa, Homo sapiens
EVQLVESGGGLVQPGGSLRLSCAASGFSFTSIGIHWVRQAPGKGLEWVAGIPPVGRYTYYADSVKGRFTISADTSKNTAYLQMNSLRAEDTAVYYCARWRSLSSGMDYWGQGTLV

SEQ ID NO: 11065 - protein, 134 aa, Homo sapiens
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVG

SEQ ID NO: 11066 - protein, 122 aa, Mus musculus
QVQLQQSGAEVKKPGASVKVSCKTSGYTFTHYEYTMHWVRQAPGQGLEWMGGVSPNNGGASYNQKFKGKATLTVDKSSNTAYMELRSLTSDDSAVYYCARRLGRGYDLASYWGQGTLVLSLQ

SEQ ID NO: 11067 - protein, 120 aa, Homo sapiens
  2.7A4
EVQLVESGGGLVKPGGSLRLSCAASGFTFSTYSMNWVRQAPGKGLEWVSSISSSGDYIYYADSVKGRFTISRDNAKNSLFLQMNSLKAEDTAVYYCARDLVTSMVAFDYWGQGTLVTVSS

SEQ ID NO: 11068 - protein, 121 aa, Homo sapiens
  2.20A8
EVQLLESGGGLVQPGGSLRLSCAASGFTFSNYAMSWVRQAPGKGLEWVSAIRGSGGSTYYADSVKGRFTISRDNSKNTLYLQMNSLRAEDTAVYYCAKDLHYDSSGYLDYWGQGTLVTVSS

SEQ ID NO: 11069 - protein, 119 aa, Homo sapiens
  3.15G8
EVQLVESGGGLVQPGGSLRLSCAASGFTFSSYWMSWVRQAPGKGLEWVANIKQDGGEKYYVDSVKGRFTISRDNAKNSLFLQMNSLRAEDTAVYYCARVQLYSDYFDYWGQGTLVTVSS

SEQ ID NO: 11070 - protein, 139 aa, Artificial Sequence
  Description of Artificial Sequence: Synthetic polypeptide
  6D10-1-1 VH amino acids-signal plus
MEWSRVFIFLLSVTAGVHSQVQLQQSGAELVRPGTSVKVSCKASGYAFTNYLMEWIKQRPGQGLEWIGVIHPGIGVTNYNEKFKGKATLTADISSSTAYMQLSSLTSEDSAVYFCARRANWDLYYFDYWGQGTTLTVSS

SEQ ID NO: 11071 - protein, 138 aa, Artificial Sequence
  Description of Artificial Sequence: Synthetic polypeptide
  10D5-2-3 VH amino acids-signal plus
MDLRLSCAFIIVLLKGVQSEVKLEESRGGLVQPGGSMKLSCVASGFTFSNYWMNWVRQSPEKGLEWVAHIRLKSDNYATHYAESVRGRFTISRDDSKSSVFLQMNNLRAEDTGIYYCTGGSNYVFAFWGQGTLVTVSA

SEQ ID NO: 11072 - protein, 136 aa, Artificial Sequence
  Description of Artificial Sequence: Synthetic polypeptide
  3B7-3-3 VH amino acids-signal plus
MGWNWIFILILSVTTGVHSEVQLQQSRPELVKPGASVKISCKASDYSFTDYYMNWVKQSPDKSLEWIGEISPSSGGTTYNQKFKAKATLTVDKSSSTAYMQLKSLTSEDSAVYYCATRGAFYFDYWGQGTALTVSS

SEQ ID NO: 11073 - protein, 120 aa, Artificial Sequence
  Description of Artificial Sequence: Synthetic polypeptide
  6D10-1-1 VH amino acids-signal minus
QVQLQQSGAELVRPGTSVKVSCKASGYAFTNYLMEWIKQRPGQGLEWIGVIHPGIGVTNYNEKFKGKATLTADISSSTAYMQLSSLTSEDSAVYFCARRANWDLYYFDYWGQGTTLTVSS

SEQ ID NO: 11074 - protein, 119 aa, Artificial Sequence
  Description of Artificial Sequence: Synthetic polypeptide
  10D5-2-3 VH amino acids-signal minus
EVKLEESRGGLVQPGGSMKLSCVASGFTFSNYWMNWVRQSPEKGLEWVAHIRLKSDNYATHYAESVRGRFTISRDDSKSSVFLQMNNLRAEDTGIYYCTGGSNYVFAFWGQGTLVTVSA

SEQ ID NO: 11075 - protein, 117 aa, Artificial Sequence
  Description of Artificial Sequence: Synthetic polypeptide
  3B7-3-3 VH amino acids-signal minus
EVQLQQSRPELVKPGASVKISCKASDYSFTDYYMNWVKQSPDKSLEWIGEISPSSGGTTYNQKFKAKATLTVDKSSSTAYMQLKSLTSEDSAVYYCATRGAFYFDYWGQGTALTVSS

SEQ ID NO: 11076 - protein, 119 aa, Artificial Sequence
  Description of Artificial Sequence: Synthetic polypeptide
  HV0 amino acids
EVQLVESGGGLVQPGGSLRLSCAASGFTFSNYWMNWVRQAPGKGLEWVGHIRLKSDNYATHYAESVRGRFTISRDDSKNSLYLQMNSLKTEDTAVYYCARGSNYVFAFWGQGTLVTVSS

SEQ ID NO: 11077 - protein, 119 aa, Artificial Sequence
  Description of Artificial Sequence: Synthetic polypeptide
  HV3 amino acids
EVQLVESGGGLVQPGGSLRLSCAASGFTFSNYWMNWVRQAPGKGLEWVAHIRLKSDNYATHYAESVRGRFTISRDDSKNSLYLQMNSLKTEDTAVYYCTGGSNYVFAFWGQGTLVTVSS

SEQ ID NO: 11078 - protein, 119 aa, Artificial Sequence
  Description of Artificial Sequence: Synthetic polypeptide
  HV4a amino acids
EVQLVESRGGLVQPGGSMRLSCAASGFTFSNYWMNWVRQAPGKGLEWVGHIRLKSDNYATHYAESVRGRFTISRDDSKSSLYLQMNSLKTEDTAVYYCAGGSNYVFAFWGQGTLVTVSS

SEQ ID NO: 11079 - protein, 119 aa, Artificial Sequence
  Description of Artificial Sequence: Synthetic polypeptide
  HV7a amino acids
EVQLVESRGGLVQPGGSMRLSCAASGFTFSNYWMNWVRQAPGKGLEWVAHIRLKSDNYATHYAESVRGRFTISRDDSKSSLYLQMNSLKTEDTGVYYCTGGSNYVFAFWGQGTLVTVSS

SEQ ID NO: 11080 - protein, 119 aa, Artificial Sequence
  Description of Artificial Sequence: Synthetic polypeptide
  HV7b amino acids
EVQLVESRGGLVQPGGSMRLSCAASGFTFSNYWMNWVRQAPGKGLEWVAHIRLKSDNYATHYAESVRGRFTISRDDSKNSVYLQMNSLKTEDTGVYYCTGGSNYVFAFWGQGTLVTVSS

SEQ ID NO: 11081 - protein, 116 aa, Artificial Sequence
  Description of Artificial Sequence: Synthetic polypeptide
EVKLEESGGGLVQPGGSMKLSCVASGFTFSNFWMDWVRQSPEKGLEWIAGIRLKSYNYATHYAESVKGRFTISRDDSKSSVYLQMNNLRAEDTGIYYCTDWDGAYWGQGTLVTVSA

SEQ ID NO: 11082 - protein, 100 aa, Artificial Sequence
  Description of Artificial Sequence: Synthetic polypeptide
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTR

SEQ ID NO: 11083 - protein, 116 aa, Homo sapiens
  MOD_RES (101)..(101): Any amino acid
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRXYFDYWGQGTLVTVSS

SEQ ID NO: 11084 - protein, 116 aa, Artificial Sequence
  Description of Artificial Sequence: Synthetic polypeptide
EVQLVESGGGLVQPGGSLKLSCAASGFTFSNFWMDWVRQASGKGLEWVGGIRLKSYNYATHYAESVKGRFTISRDDSKNTAYLQMNSLKTEDTAVYYCTRWDGAYWGQGTLVTVSS

SEQ ID NO: 11085 - protein, 116 aa, Artificial Sequence
  Description of Artificial Sequence: Synthetic polypeptide
EVQLVESGGGLVQPGGSLRLSCAASGFTFSNFWMDWVRQAPGKGLEWVGGIRLKSYNYATHYAESVKGRFTISRDDSKNTAYLQMNSLRAEDTAVYYCTRWDGAYWGQGTLVTVSS

SEQ ID NO: 11086 - protein, 116 aa, Artificial Sequence
  Description of Artificial Sequence: Synthetic polypeptide
EVQLVESGGGLVQPGGSLRLSCAASGFTFSNFWMDWVRQAPGKGLEWIAGIRLKSYNYATHYAESVKGRFTISRDDSKSTVYLQMNSLRAEDTAVYYCTDWDGAYWGQGTLVTVSS

SEQ ID NO: 11087 - protein, 116 aa, Homo sapiens
EVQLVESGGGLVQPGGSLKLSCAASGFTFSGSAMHWVRQASGKGLEWVGRIRSKANSYATAYAASVKGRFTISRDDSKNTAYLQMNSLKTEDTAVYYCTRYGMDVWGQGTTVTVSS

SEQ ID NO: 11088 - protein, 116 aa, Artificial Sequence
  Description of Artificial Sequence: Synthetic polypeptide
EVQLVESGGGLVQPGGSLKLSCAASGFTFSNFWMDWVRQASGKGLEWVGEIRLKSTNYATHYAESVKGRFTISRDDSKNTAYLQMNSLKTEDTAVYYCTRTSTGYWGQGTTVTVSS

SEQ ID NO: 11089 - protein, 116 aa, Artificial Sequence
  Description of Artificial Sequence: Synthetic polypeptide
EVQLVESGGGLVQPGGSLKLSCAASGFTFSNFWMDWVRQASGKGLEWVAEIRLKSTNYATHYAESVKGRFTISRDDSKSTVYLQMNSLKTEDTAVYYCTATSTGYWGQGTTVTVSS

SEQ ID NO: 11090 - protein, 116 aa, Artificial Sequence
  Description of Artificial Sequence: Synthetic polypeptide
EVQLVESGGGLVQPGGSLKLSCAASGFTFSNFWMDWVRQASGKGLEWVGEIRLKSTNYATHYAESVKGRFTISRDDSKNTAYLQMNSLKTEDTAVYYCTATSTGYWGQGTTVTVSS

SEQ ID NO: 11091 - protein, 116 aa, Artificial Sequence
  Description of Artificial Sequence: Synthetic polypeptide
EVKLEESGGGLVQPGGSMKLSCVASGFTFSNFWMDWVRQSPEKGLEWVAEIRLKSTNYATHYAESVKGRFTISRDDSKSSVYLQMNNLRAEDTGIYYCTATSTGYWGQGTTLTVSS

SEQ ID NO: 11092 - protein, 123 aa, Artificial Sequence
  Description of Artificial Sequence: Synthetic polypeptide
QVQLQQPGAEIVRPGASVKLSCKASGYTFTDYWMNWVKLRPGQGLEWIGIIDPSDSYASYNQKFKGKATLTVDESSSTAYMQLSSLTSEDSAVYYCARKSYYGGNYYYAMDYWGQGTSVTVSS

SEQ ID NO: 11093 - protein, 118 aa, Artificial Sequence
  Description of Artificial Sequence: Synthetic polypeptide
  Synthetic polypeptide wt 5c8 heavy chain variable region
QVQLVQSGAEVVKPGASVKLSCKASGYIFTSYYMYWVKQAPGQGLEWIGEINPSNGDTNFNEKFKSKATLTVDKSASTAYMELSSLRSEDTAVYYCTRSDGRNDMDSWGQGTLVTVSS

SEQ ID NO: 11094 - protein, 118 aa, Artificial Sequence
  Description of Artificial Sequence: Synthetic polypeptide
  Synthetic polypeptide mutant 5c8 heavy chain variable region
  MOD_RES (28)..(28): Any amino acid
  MOD_RES (30)..(33): Any amino acid
  MOD_RES (35)..(35): Any amino acid
  MOD_RES (50)..(50): Any amino acid
  MOD_RES (52)..(55): Any amino acid
  MOD_RES (57)..(66): Any amino acid
  MOD_RES (99)..(107): Any amino acid
QVQLVQSGAEVVKPGASVKLSCKASGYXFXXXXMXWVKQAPGQGLEWIGXIXXXXGXXXXXXXXXXKATLTVDKSASTAYMELSSLRSEDTAVYYCTRXXXXXXXXXWGQGTLVTVSS

SEQ ID NO: 11095 - protein, 118 aa, Artificial Sequence
  Description of Artificial Sequence: Synthetic polypeptide
QVQLVQSGAEVVKPGASVKLSCKASGYIFHSYYMYWVKQAPGQGLEWIGEINPSNGDTNFNEKFKSKATLTVDKSASTAYMELSSLRSEDTAVYYCTRSDGRNDMDSWGQGTLVTVSS

SEQ ID NO: 11096 - protein, 118 aa, Artificial Sequence
  Description of Artificial Sequence: Synthetic polypeptide
QVQLVQSGAEVVKPGASVKLSCKASGYIFTSYWMYWVKQAPGQGLEWIGEINPSNGDTNFNEKFKSKATLTVDKSASTAYMELSSLRSEDTAVYYCTRSDGRNDMDSWGQGTLVTVSS

SEQ ID NO: 11097 - protein, 118 aa, Artificial Sequence
  Description of Artificial Sequence: Synthetic polypeptide
QVQLVQSGAEVVKPGASVKLSCKASGYIFTSYYMYWVKQAPGQGLEWIGEINPNNGDTNFNEKFKSKATLTVDKSASTAYMELSSLRSEDTAVYYCTRSDGRNDMDSWGQGTLVTVSS

SEQ ID NO: 11098 - protein, 118 aa, Artificial Sequence
  Description of Artificial Sequence: Synthetic polypeptide
QVQLVQSGAEVVKPGASVKLSCKASGYIFHSYWMYWVKQAPGQGLEWIGEINPSNGDTNFNEKFKSKATLTVDKSASTAYMELSSLRSEDTAVYYCTRSDGRNDMDSWGQGTLVTVSS

SEQ ID NO: 11099 - protein, 118 aa, Artificial Sequence
  Description of Artificial Sequence: Synthetic polypeptide
QVQLVQSGAEVVKPGASVKLSCKASGYIFHSYWMYWVKQAPGQGLEWIGEINPNNGDTNFNEKFKSKATLTVDKSASTAYMELSSLRSEDTAVYYCTRSDGRNDMDSWGQGTLVTVSS

SEQ ID NO: 11100 - protein, 118 aa, Artificial Sequence
  Description of Artificial Sequence: Synthetic polypeptide
QVQLVQSGAEVVKPGASVKLSCKASGYIFHSYYMYWVKQAPGQGLEWIGEINPNNGDTNFNEKFKSKATLTVDKSASTAYMELSSLRSEDTAVYYCTRSDGRNDMDSWGQGTLVTVSS

SEQ ID NO: 11101 - protein, 118 aa, Artificial Sequence
  Description of Artificial Sequence: Synthetic polypeptide
QVQLVQSGAEVVKPGASVKLSCKASGYIFTSYWMYWVKQAPGQGLEWIGEINPNNGDTNFNEKFKSKATLTVDKSASTAYMELSSLRSEDTAVYYCTRSDGRNDMDSWGQGTLVTVSS

SEQ ID NO: 11102 - protein, 111 aa, Artificial Sequence
  Description of Artificial Sequence: Synthetic polypeptide
  Anti-CD19 VL
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 11103 - protein, 106 aa, Artificial Sequence; identical to SEQ ID NO: 6925
  Description of Artificial Sequence: Synthetic polypeptide

SEQ ID NO: 11104 - protein, 116 aa, Artificial Sequence; identical to SEQ ID NO: 6921
  Description of Artificial Sequence: Synthetic polypeptide

SEQ ID NO: 11105 - protein, 56 aa, Artificial Sequence
  Description of Artificial Sequence: Synthetic polypeptide
NQNFKDKATITADESTNTAYMELSSLRSEDTAFYFCARRDITTFYWGQGTTVTVSS

SEQ ID NO: 11106 - protein, 123 aa, Artificial Sequence; identical to SEQ ID NO: 6923
  Description of Artificial Sequence: Synthetic polypeptide

SEQ ID NO: 11107 - protein, 119 aa, Rattus sp.
QVQLQESGGGLVQPGRSMKLSCAASGFTFSSFPMAWVRQAPKKGLEWVATISTSGGRTYYRDSVKGRFTISRDNGKSILYLQMNSLRSEDTATYYCSRFRQYSGGFDYWGQGTTVTVSS

SEQ ID NO: 11108 - protein, 119 aa, Artificial Sequence [sequence omitted]

SEQ ID NO: 11109 - protein, 118 aa, Artificial Sequence
  Description of Artificial Sequence: Synthetic polypeptide
  Anti-CD3 VH
IKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 11110 - protein, 121 aa, Artificial Sequence
  Description of Artificial Sequence: Synthetic polypeptide
QVQLVESGGGVVQPGRSLRLSCSSSGFALTDYYMSWVRQAPGKGLEWLGFIANKANGHTTDYSPSVKGRFTISRDNSKNTLFLQMDSLRPEDTGVYFCARDMGIRWNFDVWGQGTPVTVSS

SEQ ID NO: 11111 - protein, 126 aa, Artificial Sequence
  Description of Artificial Sequence: Synthetic polypeptide
EVQLVESGGGVVQPGRSLRLSCSSSGFIFSSYAMYWVRQAPGKGLEWVAIIWDDGSDQHYADSVKGRFTISRDNSKNTLFLQMDSLRPEDTGVYFCARDGGHGFCSSASCFGPDYWGQGTPVTVSS

SEQ ID NO: 11112 - protein, 117 aa, Artificial Sequence
  Description of Artificial Sequence: Synthetic polypeptide
  heavy chain variable region of monoclonal antibody AbF46
EVKLVESGGGLVQPGGSLRLSCATSGFTFTDYYMSWVRQPPGKALEWLGFIRNKANGYTTEYSASVKGRFTISRDNSQSILYLQMDTLRAEDSATYYCARDNWFAYWGQGTLVTVSA

SEQ ID NO: 11113 - protein, 113 aa, Artificial Sequence
  Description of Artificial Sequence: Synthetic polypeptide
  heavy chain variable region of monoclonal antibody AbF24
QIQLVQSGPELKKPGETVKISCKASGYTFTDYSMHWVKQAPGKGLKWMGWINTETGAPTYADDFKGRFAFSLETSASTAYLQINNLKDEDTATYFCARASMISFVYWGQGTLV

SEQ ID NO: 11114 - protein, 112 aa, Artificial Sequence
  Description of Artificial Sequence: Synthetic polypeptide
  heavy chain variable region of monoclonal antibody Stan34
EVQLQQFGPDLVKPGASVRISCKASGYTFTDYNMDWVRQSHGKSLEWIGDINPNYGSTKYNQKFQGKATLTVDESSNTAYMDLRSLTSEDTAVYYCARDGQHAMDFWGQGIS

SEQ ID NO: 11115 - protein, 119 aa, Artificial Sequence [sequence omitted]

SEQ ID NO: 11116 - protein, 449 aa, Artificial Sequence; identical to SEQ ID NO: 5159
  Description of Artificial Sequence: Synthetic polypeptide
  sequence is synthesized

SEQ ID NO: 11117 - protein, 115 aa, Mus musculus
DLQLQESGPGLVKPSQSLSLTCSVTGYSITSAYFWSWIRQFPGNKLEWMGFINYDGTNNYNPSLKNRISITRDTSKNQFFLRLNSVTTDDTATYYCTRDRTFAYWGQGTLVTVSA

SEQ ID NO: 11118 - protein, 117 aa, Mus musculus
QVQLQQPGAELVKPGASVKLSCKASGYTFTSYWMHWVKQRPGQGLEWIGEINPSNGRTHYNEKFRTKATLTVAKSSITAYMQLSTLTSEDSAVYYCARRVGYLMDYWGQGTSVTAPQ

SEQ ID NO: 11119 - protein, 449 aa, Artificial Sequence; identical to SEQ ID NO: 5159
  Description of Artificial Sequence: Synthetic polypeptide

SEQ ID NO: 11120 - protein, 117 aa, Artificial Sequence
  Description of Artificial Sequence: Synthetic polypeptide
  Synthetic heavy chain variable region of anti c-Met humanized antibody(huAbF46-H4)
EVQLVESGGGLVQPGGSLRLSCAASGFTFTDYYMSWVRQAPGKGLEWLGFIRNKANGYTTEYSASVKGRFTISRDNSKNTLYLQMNSLRAEDTAVYYCARDNWFAYWGQGTLVTVSS

SEQ ID NO: 11121 - protein, 117 aa, Artificial Sequence
  Description of Artificial Sequence: Synthetic polypeptide
  heavy chain variable region of AbF46
EVQLVESGGGLVQPGGSLRLSCAASGFTFTDYYMSWVRQAPGKGLEWLGFIRNKANGYTTEYSASVKGRFTISRDNSKNSLYLQMNSLKTEDTAVYYCARDNWFAYWGQGTLVTVSS

SEQ ID NO: 11122 - protein, 119 aa, Mus musculus
QVQLQQSGPELVRPGASVKMSCRASGYTFTSYWLHWVKQRPGQGLEWIGMIDPSNSDTRFNPNFKDKATLNVDRSSNTAYMLLSSLTSADSAVYYCATYGSYVSPLDYWGQGTSVTVSS

SEQ ID NO: 11123 - protein, 121 aa, Homo sapiens
QVQLVQSGAEVKKPGSSVKVSCKASGGTFSSYGFGWVRQAPGQGLEWMGRISPILGIANYAQMFQGRVTITADKSTSTAYMELSSLRSEDTAVYYCARDVGYDWPDTFDIWGQGTMVIVSS

SEQ ID NO: 11124 - protein, 121 aa, Homo sapiens
QVQLVQSGAEVKKPGSSVKVSCKASGGTFSSFGIGWVRQAPGQGLEWMGRIFPILGTANYAQMFQGRVTITADKSTSTAYMELTSLRSEDTAVYYCARDVGYDSADAFDIWGQGTMVTVSS

SEQ ID NO: 11125 - protein, 118 aa, Homo sapiens
EVQLVQSGAEVKKPGESLKISCKGSGYSFTSYWIGWVRQMPGKGLEWMGIIYPGDSETRYSPSFQGQVTISADKSISTAYLQWSSLKASDTAMYYCARQEITGEFDYWGQGTLVTVSS

SEQ ID NO: 11126 - protein, 123 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARELLWFGELWGYFDLWGRGTLVTVSS

SEQ ID NO: 11127 - protein, 122 aa, Homo sapiens
EVQLLESGGGLVQPGGSLRLSCVASGFTFSSYAMSWVRQAPGKGLEWVSAISGSSGGSTYYVDSVKGRFTISRANSKNTLYLQMNSLRAEDTAVYYCAKDLDRGWMGYFGYWGQGTLVTVSS

SEQ ID NO: 11128 - protein, 118 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWNSLKASDTAMYYCARQEITGEFDYWGQGTLVTVSS

SEQ ID NO: 11129 - protein, 117 aa, Homo sapiens
EVQLLESGGGLVQPGGSLRLSCAASGFTFSSYAMSWVRQAPGKGLEWVSVISGSGGITYYADSVKGRFTISRDNSKNTLYLQMNSLRAEDTAVYYCARDRGWGSDYWGQGTLVTVSS

SEQ ID NO: 11130 - protein, 125 aa, Homo sapiens
EVQLVESGGGLVKPGGSLKLSCAASGFTFSDYYMYWVRQTPEKRLEWVATISDDGSYTYYPDSVKGRFTISRDNAKNNLYLQMSSLKSEDTAMYYCAREGLYYYGSGSYYNQDYWGQGTLVTVSS

SEQ ID NO: 11131 - protein, 118 aa, Homo sapiens
  MOD_RES (52)..(52): Any amino acid
QLQLQESGSGLVKPSQTLSLTCAVSGGSISSGGHSWSWIRQPPGKGLEWIGXIYHSGNTYDNPSLKSRVTIAVDRSKNQLSLKLSFLTAADTAVYYCARSSYDFLTDWGQGTLVTVSS

SEQ ID NO: 11132 - protein, 118 aa, Homo sapiens
  MOD_RES (52)..(52): Any amino acid
QLQLQESGSGLVKPSQTLSLTCAVSGGSISSGGHSWSWIRQPPGKGLEWIGXIYHSGNTYDNPSLKSRVTIAVDRSKNQLSLKLSFVTAADTAVYYCARSSYDILTDWGQGTLVTVSS

SEQ ID NO: 11133 - protein, 118 aa, Homo sapiens
  MOD_RES (52)..(52): Any amino acid
QLQLQESGSGLVKPSQTLSLTCAVSGGSISSGGHSWSWIRQPPGKGLEWIGXIYHSGNTYDNPSLKSRVTISVDRSKNQVSLKLSSVTAADTAVYYCARSSYDILTDWGQGTLVTVSS

SEQ ID NO: 11134 - protein, 118 aa, Homo sapiens
  MOD_RES (52)..(52): Any amino acid
QLQLQESGSGLVKPSQTLSLTCAVSGGSISSGGYSWSWIRQPPGKGLEWIGXIYHSGSTYYNPSLKSRVTISVDRSKNQFSLKLSSVTAADTAVYYCARSSYDILTDWGQGTLVTVSS

SEQ ID NO: 11135 - protein, 119 aa, Homo sapiens
QVQLVQSGAEVKKPGASVKVSCETSGYTFTSYGISWVRQAPGHGLEWMGWISAYNGYTNYAQKLQGRVTMTTDTSTSTAYMELRSLRSDDTAVYYCARDLRGTNYFDYWGQGTLVTVSS

SEQ ID NO: 11136 - protein, 118 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQEITGDFDYWGQGTLVTVSS

SEQ ID NO: 11137 - protein, 121 aa, Homo sapiens
QVQLVQSGAEVKKPGASVKVSCKASGYTFTNFGISWVRQAPGQGLEWMGWISAFNGHTDYSQKVQGRVTMTTDTSTSTAYMELRSLRSDDTAVFYCARSHYYGSGSPFDYWGQGTLVTVSS

SEQ ID NO: 11138 - protein, 123 aa, Homo sapiens
QVQLVQSGGEVKKPGASVKVSCKASGYTFTRHGITWVRQAPGQGLEWMGWISADNGNTNYAQKFQDRVTMTTDTSTSTAYMELRSLRSDDTAVYFCARVFRYFDWLLPYFDYWGQGTLVTVST

SEQ ID NO: 11139 - protein, 119 aa, Homo sapiens
QVQLVQSGAEVKKPGASVKVSCKASGYTFTSYGISWVRQAPGQGLEWMGWISTYNGYTNYAQKLQGRVTMTTDTSTSTAYMELRSLRSDDTAVYYCARDLRGTAYFDYWGQGTLVTVSS

SEQ ID NO: 11140 - protein, 119 aa, Homo sapiens
QVQLVQSGAEVKKPGASVKVSCEASGYTFTSYGISWVRQAPGHGLEWMGWISAYNGYTNYAQKLQGRVTMTADTSTSTAYMELRSLRSDDTAVYYCARDLRGTNYFDYWGQGTLVTVSS

SEQ ID NO: 11141 - protein, 119 aa, Homo sapiens
QVQLVQSGAEVKKPGASVKVSCEASGYTFTNYGISWVRQAPGHGLEWMGWISAYNGYTNYAQKLQGRVTMTTDTSTTTAYMELRSLRSDDTAVYYCARDLRGTNYFDYWGQGTLVTVSS

SEQ ID NO: 11142 - protein, 121 aa, Homo sapiens
QVQLVQSGAEVKKPGSSVKVSCKASGGTFSSYGFGWVRQAPGQGLEWMGRISPILGITNYAQMFQGRVTITADKSTSTAYMELSSLRSEDTAVYYCARDVGYDWPDTFDIWGQGTMVIVSS

SEQ ID NO: 11143 - protein, 121 aa, Homo sapiens
QVQLVQSGAEVKKPGSSVKVSCKASGGTFSSYGIGWVRQAPGQGLEWMGRIFPILGTANYAQMFQGRVTITADKSTSTAYIELTSLRSEDTAVYYCARDVGYDSADAFDIWGQGTMVTVSS

SEQ ID NO: 11144 - protein, 121 aa, Homo sapiens
QVQLVQSGAEVKKPGSSVKVSCKASGGTFSSYGIGWVRQAPGQGLEWMGRVFPILGTANYAQMFQGRVTITADKSTSTAYMELTSLRSEDTAVYYCARDVGYDSADAFDIWGQGTMVTVSS

SEQ ID NO: 11145 - protein, 123 aa, Homo sapiens
QVQLVESGGGVVQPGRSLRLSCAASGFTFSSYAMHWVRQAPGKGLEWVAFISYDGSNKYFADSVKGRFTISRDNSKNTLYLQMNSLRAEDTAVYYCARELLWFGELWGYFDLWGRGTLVTVSS

SEQ ID NO: 11146 - protein, 123 aa, Homo sapiens
QVQLVESGGGVVQPGRSLRLSCAASGFTFSSYAMHWVRQAPGKGLEWVAFISYDGSSKDYADSVKGRFTIFRDNSKNTLYLQMSSLRAADTAVYYCARELLWFGELWGYFDLWGRGTLVTVSS

SEQ ID NO: 11147 - protein, 117 aa, Homo sapiens
EVQLLESGGGLVQPGGSLRLSCAASGFTFSSYAMTWVRQAPGKGLEWVSVISGSGGITYYADSVKGRFTISRDNSKNTLYLQMNSLRAEDTAVYYCARDRGWGSDYWGQGTLVTVSS

SEQ ID NO: 11148 - protein, 117 aa, Homo sapiens
EVQLLESGGGLVQPGGSLRLSCAASGFTFNNYAMSWVRQAPGKGLEWVSAISGSGGITYYADSEKGRFTISRDNSKNTLYLQMNSLRAEDTAVYYCAKDRGWGSDCWGQGTLVTVSS

SEQ ID NO: 11149 - protein, 118 aa, Homo sapiens
QLQLQESGSGLVKPSQTLSLTCAVSGGSISSGGHSWSWIRQPPGKGLEWIGCLYHSGNTYYNPSLKSRVTISVDRSKNQFSLKLSSVTAADTAVYYCARSSYDILTDWGQGILVTVSS

SEQ ID NO: 11150 - protein, 118 aa, Homo sapiens
QLQLQESGSGLVKPSQTLSLTCGVSGGSISSGGHSWSWIRQPPGKGLEWIGCLYHSGNTYYNPSLKSRVTISVDRSKNQFSLKLSSVTAADTAVYYCARSSYDILTDWGQGTLVTVSS

SEQ ID NO: 11151 - protein, 118 aa, Homo sapiens
QLQLQESGSGLVKPSQTLSLTCAVSGGSISSGGHSWSWIRQPPGKGLEWIGCIYHSGNTYDNPSLKSRVTIAVDRSKNQLSLKLSFVTAADTAVYYCARSSYDILTDWGQGTLVTVSS

SEQ ID NO: 11152 - protein, 118 aa, Homo sapiens
QLQLQESGSGLVKPSQTLSLTCAVSGGSISSGGHSWSWIRQPPGKGLEWIGCIYHSGNTYDNPSLKSRVTISVDRSKNQFSLKLSSVTAADTAVYYCARSSYDILTDWGQGTLVTVSS

SEQ ID NO: 11153 - protein, 118 aa, Homo sapiens
EVQLVQSGAEVKKPGESLKISCKGSGYIFTSYWIGWVRQMPGKGLEWMGIIYPGDSDTRYSPSFQGQVTISADKSISTAYLQWSSLKASDTAMYYCARQEVTGDFDYWGQGTLVTVSS

SEQ ID NO: 11154 - protein, 118 aa, Homo sapiens
EVQLVQSGGEVKKPGESLKISCKGSGYSFTSYWIGWVRQMPGKGLEWMGIIYPGDSDTRYSPSFQGQVTISADKSISTAYLQWSSLKASDTAMYYCARQEVTGDFDYWGQGTLVTVSS

SEQ ID NO: 11155 - protein, 118 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQEITGEFDYWGQGTLVTVSS

SEQ ID NO: 11156 - protein, 118 aa, Homo sapiens
EVQLVQSGAEVKKPGESLKISCKGSGYSFTSYWIGWVRQMPGKGLEWMGIIYPGDSNTRYSPSFQGQVTISADKSISTAYLQWSSLKASDTAMYYCARQEITGDFDYWGQGTLVTVSS

SEQ ID NO: 11157 - protein, 118 aa, Homo sapiens
EVQLVQSGAEVKKPGESLKISCKGSGYSFISYWIGWVRQMPGKGLEWMGIIYPGDSDTRYSPSFQGQVTISADKSISTAYLQWSSLKASDTAMYYCARQEITGDFDYWGQGTLVTVSS

SEQ ID NO: 11158 - protein, 127 aa, Artificial Sequence
  Description of Artificial Sequence: Synthetic polypeptide
  Variable domain
QVQLVESGPGLVKPSQTLSLTCTVSGGSISTNYYYWSWIRQSPGKGLEWIGVIAYEGSTDYSPSLKSRVTISRDTSKNQFSLKLSSVTAEDTAVYYCARDVRVIATGWATANALDAWGQGTLVTVSS

SEQ ID NO: 11159 - protein, 127 aa, Artificial Sequence
  Description of Artificial Sequence: Synthetic polypeptide
  Variable domain
QVQLQESGPGLVKPSQTLSLTCAVSGGSISTNYYYWSWIRQHPGKGLEWIGVIAYEGSTDYSPSLKSRVTISVDTSKNQFSLQLSSVTPEDTAVYYCARDVRVIATGWATANALDAWGQGTLVTVSS

SEQ ID NO: 11160 - protein, 127 aa, Artificial Sequence
  Description of Artificial Sequence: Synthetic polypeptide
  Variable domain
QVQLQESGPGLVKPSQTLSLTCTVSGGSITTNYYYWSWIRQSPGKGLEWIGVIAYEGSTDYSPSLKSRVTISRDTSKNQFSLQLSSVTAEDTAVYYCARDVRVIATGWATANALDAWGQGTLVTVSS

SEQ ID NO: 11161 - protein, 127 aa, Artificial Sequence
  Description of Artificial Sequence: Synthetic polypeptide
  Variable domain
QVQLQESGPGLVKPSQTLSLTCTVSGGSITTNYYYWSWIRQSPGKGLEWIGVIAYDASTDYSPSLKSRVTISRDTSKNQFSLQLSSVTAEDTAVYYCARDVRVIATGWATANALDAWGQGTLVTVSS

SEQ ID NO: 11162 - protein, 119 aa, Artificial Sequence
  Description of Artificial Sequence: Synthetic polypeptide
  Variable domain
EVQLVQPGAEVKKPGASVKVSCKASGYIFTMNSIDWVRQAPGQGLEWMGRIDPEEGGTKYAQKFQGRVTMTADTSTSTAYMELSSLRSDDTAVYYCARVDDYYLGYDYWGQGTQVTVSS

SEQ ID NO: 11163 - protein, 119 aa, Artificial Sequence
  Description of Artificial Sequence: Synthetic polypeptide
  Variable domain
QVQLVQSGAEVKKPGASVKVSCKASGYTFTMNSIDWVRQAPGQGLEWMGRIDPEEGGTKYAQKFQGRVTFTRDTSTSTAYMELSSLRSDDTAVYYCARVDDYYLGYDYWGQGTQVTVSS

SEQ ID NO: 11164 - protein, 119 aa, Artificial Sequence
  Description of Artificial Sequence: Synthetic polypeptide
  Variable domain
EVQLVQPGAEVKKPGASVKVSCKASGYTFTMNSIDWVRQAPGQGLEWMGRIDPEEGGTKYAQKFQGRVTFTRDTSTSTAYVELSSLRSDDTAVYYCARVDDYYLGYDYWGQGTLVTVSS

SEQ ID NO: 11165 - protein, 119 aa, Artificial Sequence
  Description of Artificial Sequence: Synthetic polypeptide
  Variable domain
QVQLVQPGVEVKKPGASVKVSCKASGYTFTMNSIDWVRQAPGQGLEWMGRIDPEEGGTKYAQKFQGRVTFTADTSTSTAYMELSSLRSDDTAVYYCARVDDYYLGYDYWGQGTQVTVSS

SEQ ID NO: 11166 - protein, 119 aa, Artificial Sequence
  Description of Artificial Sequence: Synthetic polypeptide
  Variable domain
QVQLVQPGAEVKKPGASVKVSCKASGYTFTMNSIDWVRQAPGQGLEWMGRIDPEEGGTKYAQKFQGRVTFTADTSTSTAYVELNSLRSEDTAVYYCARVDDYYLGYDYWGQGTQVTVSS

SEQ ID NO: 11167 - protein, 119 aa, Artificial Sequence
  Description of Artificial Sequence: Synthetic polypeptide
  Variable domain
QVQLVQPGAELRNPGASVKVSCKASGYTFTMNSIDWVRQAPGQGLEWMGRIDPEEGGTKYAQKFQGRVTMTRDTSTSTAYMELSSLRSEDTAVYYCARVDDYYLGYDYWGQGTQVTVSS

SEQ ID NO: 11168 - protein, 119 aa, Artificial Sequence
  Description of Artificial Sequence: Synthetic polypeptide
  Variable domain
QVQLVQPGAEVKKPGASVKVSCKASGYIFTMNSIDWVRQAPGQGLEWMGRIDPEEGGTKYAQKFQGRVTMTADTSTSTAYMELNSLRSEDTAVYYCARVDDYYLGYDYWGQGTLVTVSS

SEQ ID NO: 11169 - protein, 118 aa, Mus musculus
QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSS

SEQ ID NO: 11170 - protein, 223 aa, Homo sapiens
EVQLVESGGGVVQPGRSLRLSCAASGFTFSSYAMHWVRQAPGKGLEWVAVIWYDGSNRYYADSVKGRFTISRDNSKNTLYLQMNSLRAEDTAVYYCASQATEGLIWGQGTLVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTS

SEQ ID NO: 11171 - protein, 121 aa, Homo sapiens
QVQLVQSGAEVKKPGASVKVSCKASGYTFTGYYMNWVRQAPGQGLEWMGIINPWTGNTNYAQKFQGRVTMTRDTSISTAYMELSSLRSEDTAVYYCARDPGFFYYTPSDLWGQGTLVTVSS

SEQ ID NO: 11172 - protein, 121 aa, Homo sapiens
QVQLVQSGAEVKKPGASVKVSCKASGYTFTGYYMNWVRQAPGQGLEWMGIIDPWNGQTNYAQKFQGRVTMTRDTSISTAYMELSSLRSEDTAVYYCARDPGFFYYTPSDLWGQGTLVTVSS

SEQ ID NO: 11173 - protein, 121 aa, Homo sapiens
QVQLVQSGAEVKKPGASVKVSCKASGYTFTGYYMNWVRQAPGQGLEWMGVIDPWNGITNYAQKFQGRVTMTRDTSISTAYMELSSLRSEDTAVYYCARDPGFFYYTPSDLWGQGTLVTVSS

SEQ ID NO: 11174 - protein, 113 aa, Homo sapiens
QVQLVQSGAEVKKPGSSVKVSCKASGGTFSSYAISWVRQAPGQGLEWMGGIDPFGTANYAQKFQGRVTITADESTSTAYMELSSLRSEDTAVYYCARVYQDVWGQGTLVTVSS

SEQ ID NO: 11175 - protein, 113 aa, Homo sapiens
QVQLVQSGAEVKKPGSSVKVSCKASGGTFSSYAISWVRQAPGQGLEWMGGIDPIMGTEYAQKFQGRVTITADESTSTAYMELSSLRSEDTAVYYCARVYQDVWGQGTLVTVSS

SEQ ID NO: 11176 - protein, 114 aa, Homo sapiens
QVQLVQSGAEVKKPGSSVKVSCKASGGTFSSYAISWVRQAPGQGLEWMGEIDPVIGETDYAQKFQGRVTITADESTSTAYMELSSLRSEDTAVYYCARVYQDVWGQGTLVTVSS

SEQ ID NO: 11177 - protein, 121 aa, Homo sapiens
QVQLQESGPGLVKPGETLSLTCTVSGGSISSSSYYWNWIRQAPGKGLEWIGEIYFGWTYYNPSLKGRVTISVDTSKNQFSLKLSSVTAEDTAVYYCARGYEFHGYTTFDYWGQGTLVTVSS

SEQ ID NO: 11178 - protein, 116 aa, Homo sapiens
QVQLVQSGAEVKKPGESLKISCKGSGYSFSNYWIGWVRQMPGKGLEWMGFIFPDTSYTRYSPSFQGQVTISADKSISTAYLQWSSLKASDTAMYYCARVKLITDYWGQGTLVTVSS

SEQ ID NO: 11179 - protein, 125 aa, Homo sapiens
QVQLQQSGPGLVKPSQTLSLTCAISGDSVSSNSAAWGWIRQSPGRGLEWLGRIYYRSKWVNDYAVSVKSRITINPDTSKNQFSLQLNSVTPEDTAVYYCARQGAVYPGPYGFDVWGQGTLVTVSS

SEQ ID NO: 11180 - protein, 123 aa, Homo sapiens
QVQLVQSGAEVKKPGESLKISCKGSGYSFTNYGIAWVRQMPGKGLEWMGIIYPSDSYTNYSPSFQGQVTISADKSISTAYLQWSSLKASDTAMYYCARMSYDYQHQAPSMDSWGQGTLVTVSS

SEQ ID NO: 11181 - protein, 115 aa, Artificial Sequence
  Description of Artificial Sequence: Synthetic polypeptide
  synthetic construct
QVQLVQSGAEVKKPGSSVKVSCKASGYTFTSRYIHWVRQAPGQGLEWMGWIYPVTGDTYYNEKFKGRVTITADKSTSTAYMELSSLRSEDTAVYYCARGYGAFYYWGQGTLVTVS

SEQ ID NO: 11182 - protein, 115 aa, Artificial Sequence
  Description of Artificial Sequence: Synthetic polypeptide
  synthetic construct
QVQLVQSGAEVKKPGSSVKVSCKASGYTFTSRYIHWVRQAPGQGLEWMGWIYPVTGDTYYIEKFKGRVTITADKSTSTAYMELSSLRSEDTAVYYCARGYGAFFYWGQGTLVTVS

SEQ ID NO: 11183 - protein, 115 aa, Artificial Sequence
  Description of Artificial Sequence: Synthetic polypeptide
  synthetic construct
QVQLVQSGAEVKKPGSSVKVSCKASGYTFTSRYIHWVRQAPGQGLEWMGWIYPVTGDTYYREPFKGRVTITADKSTSTAYMELSSLRSEDTAVYYCARGYGAFYYWGQGTLVTVS

SEQ ID NO: 11184 - protein, 114 aa, Artificial Sequence
  Description of Artificial Sequence: Synthetic polypeptide
  synthetic construct
QVQLVQSGAEVKKPGASVKVSCKASGYTFTDYYMHWVRQAPGQGLEWMGRVNPNRGGTTYNQKFEGRVTMTTDTSTSTAYMELRSLRSDDTAVYYCARTNWLDYWGQGTTVTVS

SEQ ID NO: 11185 - protein, 114 aa, Artificial Sequence
  Description of Artificial Sequence: Synthetic polypeptide
  synthetic construct
QVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVS

SEQ ID NO: 11186 - protein, 114 aa, Artificial Sequence
  Description of Artificial Sequence: Synthetic polypeptide
  synthetic construct
QVQLVQSGAEVKKPGASVKVSCKASGYTFTDYYMHWVRQAPGQGLEWMGRVNPYRGSTTYNQKFEGRVTMTTDTSTSTAYMELRSLRSDDTAVYYCARANILDYWGQGTTVTVS

SEQ ID NO: 11187 - protein, 115 aa, Artificial Sequence
  Description of Artificial Sequence: Synthetic polypeptide
  synthetic construct
  MOD_RES (61)..(61): Any naturally occurring amino acid
  MOD_RES (63)..(63): Any naturally occurring amino acid
  MOD_RES (104)..(104): Any naturally occurring amino acid
QVQLVQSGAEVKKPGSSVKVSCKASGYTFTSRYIHWVRQAPGQGLEWMGWIYPVTGDTYYXEXFKGRVTITADKSTSTAYMELSSLRSEDTAVYYCARGYGAFXYWGQGTLVTVS

SEQ ID NO: 11188 - protein, 114 aa, Artificial Sequence
  Description of Artificial Sequence: Synthetic polypeptide
  synthetic construct
  MOD_RES (54)..(54): Any naturally occurring amino acid
  MOD_RES (56)..(57): Any naturally occurring amino acid
  MOD_RES (99)..(99): Any naturally occurring amino acid
  MOD_RES (101)..(101): Any naturally occurring amino acid
QVQLVQSGAEVKKPGASVKVSCKASGYTFTDYYMHWVRQAPGQGLEWMGRVNPXRXXTTYNQKFEGRVTMTTDTSTSTAYMELRSLRSDDTAVYYCARXNXLDYWGQGTTVTVS

SEQ ID NO: 11189 - protein, 121 aa, Mus musculus
EVKLVESGGDLVKPGGSLQLSCAASGFTFSSYAMSWVRQTPEMRLEWVASIMGGGTTYYPDSVKGRFTISRDIARNILNLQMSSLRSEDTAIYYCARGRDYGIRSYAMDYWGQGTSVTVSS

SEQ ID NO: 11190 - protein, 119 aa, Mus musculus
QVQLKQSGPGLVQPSQSLSITCTVSGFSLTDYGIQWVRQSPGQGLEWLGVIWRGGSTDYNAPFMSRLSITKDNSKSQVFFRMNSLQADDTAIYYCATSYYRYDGPFTYWGQGTLVTVSA

SEQ ID NO: 11191 - protein, 114 aa, Artificial Sequence
  Description of Artificial Sequence: Synthetic polypeptide
  Synthetic heavy chain variable region of anti c-Met humanized antibody(huAbF46-H4)
DIQMTQSPSSLSASVGDRVTITCKSSQSLLASGNQNNYLAWHQQKPGKAPKMLIIWASTRVSGVPSRFSGSGSGTDFTLTISSLQPEDFATYYCGQSYSRPLTFGQGTKVEIKR

SEQ ID NO: 11192 - protein, 117 aa, Artificial Sequence
  Description of Artificial Sequence: Synthetic polypeptide
  Synthetic (heavy chain variable region of AT-VH3)
EVQLVESGGGLVQPGGSLRLSCATSGFTFTDYYMSWVRQPPGKGLEWLGFIRNKANGYTTEYSASVKGRFTISRDNSKSTLYLQMNSLRAEDTATYYCARDNWFAYWGQGTLVTVSS

SEQ ID NO: 11193 - protein, 117 aa, Artificial Sequence
  Description of Artificial Sequence: Synthetic polypeptide
  Synthetic (heavy chain variable region of AT-VH4)
EVQLVESGGGLVQPGGSLRLSCATSGFTFTDYYMSWVRQPPGKGLEWLGFIRNKANGYTTEYSASVKGRFTISRDNSKNTLYLQMNSLRAEDTATYYCARDNWFAYWGQGTLVTVSS

SEQ ID NO: 11194 - protein, 117 aa, Artificial Sequence
  Description of Artificial Sequence: Synthetic polypeptide
  Synthetic (heavy chain variable region of AT-VH5)
EVQLVESGGGLVQPGGSLRLSCATSGFTFTDYYMSWVRQPPGKGLEWLGFIRNKANGYTTEYSASVKGRFTISRDNSKNTLYLQMNSLRAEDTAVYYCARDNWFAYWGQGTLVTVSS

SEQ ID NO: 11195 - protein, 119 aa, Artificial Sequence; identical to SEQ ID NO: 11122
  Description of Artificial Sequence: Synthetic polypeptide

SEQ ID NO: 11196 - protein, 119 aa, Homo sapiens; identical to SEQ ID NO: 10673

SEQ ID NO: 11197 - protein, 112 aa, Artificial Sequence
  Description of Artificial Sequence: Synthetic polypeptide
  cMu9VH amino acid sequence
QVQLQESGPELVKPGASVKMSCRASGYTFTEYVITWVKQRTGQGLEWIGEIYPGSGSTSYNEKFKGKATLTADKSSNTAYMHLSSLTSEDSAVYFCTREDLGGQGTLVTVSS

SEQ ID NO: 11198 - protein, 112 aa, Artificial Sequence
  Description of Artificial Sequence: Synthetic polypeptide
  hMu9VH amino acid sequence
QVQLQQSGAEVKKPGSSVKVSCKASGYTFTEYVITWVKQRPGQGLEWIGEIYPGSGSTSYNEKFKGKATITADKSTNTAYMELSSLRSEDTAFYFCTREDLGGQGSLVTVSS

SEQ ID NO: 11199 - protein, 116 aa, Mus musculus
QVQLKESGPGLVAPSQSLSITCTVSGFSLTTYDISWIRQSPGKGLEWLGVIWTDGGTNYNSPFMSRLSIRKDNSKSQVFLKMNRLQTDDTAIYYCVRDQRLYFDVWGAGTTVTVSS

SEQ ID NO: 11200 - protein, 116 aa, Mus musculus
QVQLKESGPGLVAPSKSLSITCTVSGSSLDSFDISWIRQSPGKGLEWLGVIWTGGGTNYNSGFMSRLRITKDNSKSQVLLKMNSLQSDDTAIYYCVRDPRLYFDVWGAGTTVTVSS

SEQ ID NO: 11201 - protein, 116 aa, Artificial Sequence
  Description of Artificial Sequence: Synthetic polypeptide
  heavy chain variable domain, hMab 2F11-c11
QVQLVQSGAEVKKPGSSVKVSCKASGFSLTTYDISWIRQAPGQGLEWMGVIWTDGGTNYNSPFMSRVTITKDESTSTAYMELSSLRSEDTAVYYCVRDQRLYFDVWGQGTTVTVSS

SEQ ID NO: 11202 - protein, 116 aa, Artificial Sequence
  Description of Artificial Sequence: Synthetic polypeptide
  heavy chain variable domain, hMab 2F11-d8
QVQLVQSGAEVKKPGSSVKVSCKASGFSLTTYDISWVRQAPGQGLEWMGVIWTDGGANYAQKFQGRVTITADESTSTAYMELSSLRSEDTAVYYCARDQRLYFDVWGQGTTVTVSS

SEQ ID NO: 11203 - protein, 116 aa, Artificial Sequence; identical to SEQ ID NO: 6329
  Description of Artificial Sequence: Synthetic polypeptide
  heavy chain variable domain, hMab 2F11-e7

SEQ ID NO: 11204 - protein, 116 aa, Artificial Sequence
  Description of Artificial Sequence: Synthetic polypeptide
  heavy chain variable domain, hMab 2F11-f12
QVQLVQSGAEVKKPGSSVKVSCKASGFSLTTYDISWVRQAPGQGLEWMGVIWTDGGTNYNSPFMSRVTITKDESTSTAYMELSSLRSEDTAVYYCVRDQRLYFDVWGQGTTVTVSS

SEQ ID NO: 11205 - protein, 116 aa, Artificial Sequence
  Description of Artificial Sequence: Synthetic polypeptide
  heavy chain variable domain, hMab 2F11-g1
QVQLQESGPGLVKPSETLSLTCTVSGFSLTTYDISWIRQPPGKGLEWIGVIWTDGGTNYNSPLKSRVTISVDTSKNQFSLKLSSVTAADTAVYYCARDQRLYFDVWGQGTTVTVSS

SEQ ID NO: 11206 - protein, 116 aa, Mus musculus
RVQLKESGPGLVAPSQSLSITCTVSGFSLTSYDISWIRQSPGKGLEWLGVIWSGGGTNYNSPFMSRLRISKDDSRSQVFLKVNRLQTDDTAIYYCVRDLRLYFDVWGAGTTVTVSS

SEQ ID NO: 11207 - protein, 116 aa, Mus musculus
QVQLKESGPGLVAPSKSLSITCTVSGSSLDSFDISWIRQPPGKGLEWLGVIWTGGGTNYNSGFMSRLRISKDNSKSQVFLKMSSLQSDDTAIYYCVRDPRLYFDVWGAGTTVTVSS

SEQ ID NO: 11208 - protein, 126 aa, Homo sapiens
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSS

SEQ ID NO: 11209 - protein, 113 aa, Artificial Sequence; identical to SEQ ID NO: 5819
  Description of Artificial Sequence: Synthetic polypeptide
  humanized S2C6 heavy chain variable domain variant

SEQ ID NO: 11210 - protein, 120 aa, Artificial Sequence
  Description of Artificial Sequence: Synthetic polypeptide
  humanized VH
EVQLVESGGGLVQPGRSLRLSCTASGFTFTDNYMSWVRQAPGKGLEWVGFIRNKANGYTTEYAASVKGRFTISRDDSKSIAYLQMNSLKTEDTAVYYCARDVGSNYFDYWGQGTLVTVSS

SEQ ID NO: 11211 - protein, 120 aa, Artificial Sequence
  Description of Artificial Sequence: Synthetic polypeptide
  humanized VH
EVQLVESGGGLVQPGRSLRLSCTASGFTFTDNYMSWVRQAPGKGLEWVGFIRNKANGYTTEYAASVKGRFTISRDNSKSIAYLQMNSLKTEDTAVYYCARDVGSNYFDYWGQGTLVTVSS

SEQ ID NO: 11212 - protein, 120 aa, Artificial Sequence
  Description of Artificial Sequence: Synthetic polypeptide
  humanized VH
EVQLVESGGGLVQPGRSLRLSCTASGFTFTDNYMSWVRQAPGKGLEWLGFIRNKANGYTTEYAASVKGRFTISRDNSKSIAYLQMNSLKTEDTAVYYCARDVGSNYFDYWGQGTLVTVSS

SEQ ID NO: 11213 - protein, 120 aa, Artificial Sequence
  Description of Artificial Sequence: Synthetic polypeptide
  humanized VH
EVNLVESGGGLVQPGRSLRLSCTASGFTFTDNYMSWVRQAPGKGLEWLGFIRNKANGYTTDYAASVRGRFTISRDNSKSILYLQMNALRTEDTAVYYCARDVGSNYFDYWGQGTLVTVSS

SEQ ID NO: 11214 - protein, 112 aa, Artificial Sequence
  Description of Artificial Sequence: Synthetic polypeptide
  humanized VL
DIVMTQSPDSLAVSLGERATINCKSSQSLFNSRTRKNYLAWYQQKPGQPPKLLIYWASARDSGVPDRFTGSGSETYFTLTISSLQAEDVAVYYCMQSFNLRTFGQGTKVEIK

SEQ ID NO: 11215 - protein, 450 aa, Artificial Sequence
  Description of Artificial Sequence: Synthetic polypeptide
  humanized VH
EVQLVESGGGLVQPGRSLRLSCTASGFTFTDNYMSWVRQAPGKGLEWVGFIRNKANGYTTEYAASVKGRFTISRDDSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11216 - protein, 450 aa, Artificial Sequence
  Description of Artificial Sequence: Synthetic polypeptide
  humanized VH
EVQLVESGGGLVQPGRSLRLSCTASGFTFTDNYMSWVRQAPGKGLEWVGFIRNKANGYTTEYAASVKGRFTISRDNSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11217 - protein, 450 aa, Artificial Sequence
  Description of Artificial Sequence: Synthetic polypeptide
  humanized VH
EVQLVESGGGLVQPGRSLRLSCTASGFTFTDNYMSWVRQAPGKGLEWLGFIRNKANGYTTEYAASVKGRFTISRDNSKSIAYLQMNSLKTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11218 - protein, 450 aa, Artificial Sequence
  Description of Artificial Sequence: Synthetic polypeptide
  humanized VH
EVNLVESGGGLVQPGRSLRLSCTASGFTFTDNYMSWVRQAPGKGLEWLGFIRNKANGYTTDYAASVRGRFTISRDNSKSILYLQMNALRTEDTAVYYCARDVGSNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 11219 - protein, 122 aa, Artificial Sequence
  Description of Artificial Sequence: Synthetic polypeptide
QVQLQQPGAELVKPGASVKLSCKASGYTFTNYYIYWVKQRPGQGLEWIGGINPTSGGSNFNEKFKTKATLTVDESSTTAYMQLSSLTSEDSAVYYCTRQGLWFDSDGRGFDFWGQGTTLTVS

SEQ ID NO: 11220 - protein, 120 aa, Artificial Sequence
  Description of Artificial Sequence: Synthetic polypeptide
QVQLQQPGAELVKPGASVKLSCKASGYTFTSHWMHWVKQRAGQGLEWIGEFNPSNGRTNYNEKFKSKATLTVDKSSSTAYMQLSSLTSEDSAVYYCASRDYDYDGRYFDYWGQGTTLTVS

SEQ ID NO: 11221 - protein, 120 aa, Artificial Sequence
  Description of Artificial Sequence: Synthetic polypeptide
QVQLVQSGAEVKKPGASVKVSCKASGYTFTSHWMHWVRQAPGQGLEWIGEFNPSNGRTNYNEKFKSKATMTVDTSTNTAYMELSSLRSEDTAVYYCASRDYDYDGRYFDYWGQGTLVTVS

SEQ ID NO: 11222 - protein, 118 aa, Artificial Sequence
  Description of Artificial Sequence: Synthetic polypeptide
QVQLKQSGPSLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVS

SEQ ID NO: 11223 - protein, 123 aa, Artificial Sequence
  Description of Artificial Sequence: Synthetic polypeptide
EVQLVESGGGLVQPGGSLRLSCSASGFTFSSYAMHWVRQAPGKGLEYVSAISSNGGSTYYADSVKGRFTISRDNSKNTLYSQMSSLRAEDTAVYYCFKDVGGSSWYWADYFDYWGQGTLVTVS

SEQ ID NO: 11224 - protein, 125 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSRLSEDTAVYYCARDPDYYGSGSYYPNWFDPWGQGTLVTVS

SEQ ID NO: 11225 - protein, 119 aa, Artificial Sequence
  Description of Artificial Sequence: Synthetic polypeptide
  Variable HC S25C/Y104D
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 11226 - protein, 293 aa, Artificial Sequence
  Description of Artificial Sequence: Synthetic polypeptide
  EGFR construct
MATGSRTSLLLAFGLLCLPWLQEGSAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 11227 - protein, 232 aa, Artificial Sequence [sequence omitted]

SEQ ID NO: 11228 - protein, 291 aa, Artificial Sequence
  Description of Artificial Sequence: Synthetic polypeptide
  IGF-1R construct
MATGSRTSLLLAFGLLCLPWLQEGSAQVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 11229 - protein, 232 aa, Artificial Sequence
  Description of Artificial Sequence: Synthetic polypeptide
  EGFR construct
MATGSRTSLLLAFGLLCLPWLQEGSAAPDVQDCPECTLQENPFFSQPGAPILQCMGCCFSRAYPTPLRSKKTMLVQKNVTSESTCCVAKSYNRVTVMGGFKVENHTACHCSTCQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11230 - protein, 135 aa, Artificial Sequence
  Description of Artificial Sequence: Synthetic polypeptide
  synthetic construct
MDWTWRILFLVAAATGVHSQVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 11231 - protein, 116 aa, Mus musculus
LVKLQESGPSLVKPSQSLSLTCTVTGYSITSDYAWNWIRQFPGNKLEWMGYISYSANTRYNPSLKSRISITRDTSKNQFFLQLNSVTTEDTATYYCATAGRGFPYWGQGTLVTVSA

SEQ ID NO: 11232 - protein, 116 aa, Artificial Sequence
  Description of Artificial Sequence: Synthetic polypeptide
  synthetic construct
QVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 11233 - protein, 116 aa, Mus musculus
DVQLQESGPSLVKPSQTLSLTCTVTGYSITSDFAWNWIRQFPGNKLEWMGYISYSGNTRYNPSLKSRISITRDTSKNQFFLQLNSVTIEDTATYYCVTAGRGFPYWGQGTLVTVSA

SEQ ID NO: 11234 - protein, 116 aa, Artificial Sequence
  Description of Artificial Sequence: Synthetic polypeptide
  synthetic construct
QVQLQESGPGLVKPSQTLSLTCTVSGYSISSDFAWNWIRQPPGKGLEWMGYISYSGNTRYQPSLKSRITITRDTSKSQFFLQLNSVTAPDTATYYCVTAGRGFPYWGQGTLVTVSS

SEQ ID NO: 11235 - protein, 120 aa, Rattus norvegicus
QVNLLQSGAALVKPGASVKLSCKGSGFTFTDYKIHWVKQSHGKSLEWIGYFNPNSGYSTYNEKFKSKATLTADKSTDTAYMELTSLTSEDSATYYCTRLSPGGYYVMDAWGQGASVTVSS

SEQ ID NO: 11236 - protein, 120 aa, Artificial Sequence [sequence omitted]

SEQ ID NO: 11237 - protein, 118 aa, Artificial Sequence
  Description of Artificial Sequence: Synthetic polypeptide
  anti-IGF-1R VH
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSS

SEQ ID NO: 11238 - protein, 118 aa, Artificial Sequence
  Description of Artificial Sequence: Synthetic polypeptide
  anti-IGF-1R VH
QVQLVESGGGVVQPGRSLRLSCAASGFTFSSYGMHWVRQAPGKGLEWMAIIWFDGSSKYYGDSVKGRFTISRDNSKNTLYLQMNSLRADDTAVYYCARELGRRYFDLWGRGTLVTVSS

SEQ ID NO: 11239 - protein, 119 aa, Artificial Sequence
  Description of Artificial Sequence: Synthetic polypeptide
EVQLVESGGGLVQPGGSLRLSCAASGFSLTNYGVHWVRQAPGKGLEWLGVIWSGGNTDYNTPFTSRLTINKDNSKNTVYLQMNSLRAEDTAVYYCARALTYYDYEFAYWGQGTLVTVSS

SEQ ID NO: 11240 - protein, 119 aa, Artificial Sequence
  Description of Artificial Sequence: Synthetic polypeptide
  Variable HC T023K
QVQLKQSGPGLVQPSQSLSITCKVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11241 - protein, 119 aa, Artificial Sequence
  Description of Artificial Sequence: Synthetic polypeptide
  Variable HC T023H
QVQLKQSGPGLVQPSQSLSITCHVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11242 - protein, 119 aa, Artificial Sequence
  Description of Artificial Sequence: Synthetic polypeptide
  Variable HC T023R
QVQLKQSGPGLVQPSQSLSITCRVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11243 - protein, 119 aa, Artificial Sequence
  Description of Artificial Sequence: Synthetic polypeptide
  Variable HC T023A
QVQLKQSGPGLVQPSQSLSITCAVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11244 - protein, 119 aa, Artificial Sequence
  Description of Artificial Sequence: Synthetic polypeptide
  Variable HC T023C
QVQLKQSGPGLVQPSQSLSITCCVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11245 - protein, 119 aa, Artificial Sequence
  Description of Artificial Sequence: Synthetic polypeptide
  Variable HC T023E
QVQLKQSGPGLVQPSQSLSITCEVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11246 - protein, 119 aa, Artificial Sequence
  Description of Artificial Sequence: Synthetic polypeptide
  Variable HC T023G
QVQLKQSGPGLVQPSQSLSITCGVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11247 - protein, 119 aa, Artificial Sequence
  Description of Artificial Sequence: Synthetic polypeptide
  Variable HC T023I
QVQLKQSGPGLVQPSQSLSITCIVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11248 - protein, 119 aa, Artificial Sequence
  Description of Artificial Sequence: Synthetic polypeptide
  Variable HC T023M
QVQLKQSGPGLVQPSQSLSITCMVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11249 - protein, 119 aa, Artificial Sequence
  Description of Artificial Sequence: Synthetic polypeptide
  Variable HC T023N
QVQLKQSGPGLVQPSQSLSITCNVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11250 - protein, 119 aa, Artificial Sequence
  Description of Artificial Sequence: Synthetic polypeptide
  Variable HC T023P
QVQLKQSGPGLVQPSQSLSITCPVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11251 - protein, 119 aa, Artificial Sequence
  Description of Artificial Sequence: Synthetic polypeptide
  Variable HC T023S
QVQLKQSGPGLVQPSQSLSITCSVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11252 - protein, 119 aa, Artificial Sequence
  Description of Artificial Sequence: Synthetic polypeptide
  Variable HC T023V
QVQLKQSGPGLVQPSQSLSITCVVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11253 - protein, 119 aa, Artificial Sequence
  Description of Artificial Sequence: Synthetic polypeptide
  Variable HC T023W
QVQLKQSGPGLVQPSQSLSITCWVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11254 - protein, 119 aa, Artificial Sequence
  Description of Artificial Sequence: Synthetic polypeptide
  Variable HC T023L
QVQLKQSGPGLVQPSQSLSITCLVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11255 - protein, 119 aa, Artificial Sequence
  Description of Artificial Sequence: Synthetic polypeptide
  Variable HC V024R
QVQLKQSGPGLVQPSQSLSITCTRSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11256 - protein, 119 aa, Artificial Sequence
  Description of Artificial Sequence: Synthetic polypeptide
  Variable HC V024A
QVQLKQSGPGLVQPSQSLSITCTASGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11257 - protein, 119 aa, Artificial Sequence
  Description of Artificial Sequence: Synthetic polypeptide
  Variable HC  V024F
QVQLKQSGPGLVQPSQSLSITCTFSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11258 - protein, 119 aa, Artificial Sequence
  Description of Artificial Sequence: Synthetic polypeptide
  Variable HC  V024G
QVQLKQSGPGLVQPSQSLSITCTGSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11259 - protein, 119 aa, Artificial Sequence
  Description of Artificial Sequence: Synthetic polypeptide
  Variable HC  V024I
QVQLKQSGPGLVQPSQSLSITCTISGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11260 - protein, 119 aa, Artificial Sequence
  Description of Artificial Sequence: Synthetic polypeptide
  Variable HC  V024M
QVQLKQSGPGLVQPSQSLSITCTMSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11261 - protein, 119 aa, Artificial Sequence
  Description of Artificial Sequence: Synthetic polypeptide
  Variable HC  V024P
QVQLKQSGPGLVQPSQSLSITCTPSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11262 - protein, 119 aa, Artificial Sequence
  Description of Artificial Sequence: Synthetic polypeptide
  Variable HC  V024S
QVQLKQSGPGLVQPSQSLSITCTSSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11263 - protein, 119 aa, Artificial Sequence
  Description of Artificial Sequence: Synthetic polypeptide
  Variable HC  V024T
QVQLKQSGPGLVQPSQSLSITCTTSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11264 - protein, 119 aa, Artificial Sequence
  Description of Artificial Sequence: Synthetic polypeptide
  Variable HC  V024L
QVQLKQSGPGLVQPSQSLSITCTLSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11265 - protein, 119 aa, Artificial Sequence
  Description of Artificial Sequence: Synthetic polypeptide
  Variable HC  S025H
QVQLKQSGPGLVQPSQSLSITCTVHGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11266 - protein, 119 aa, Artificial Sequence
  Description of Artificial Sequence: Synthetic polypeptide
  Variable HC  S025R
QVQLKQSGPGLVQPSQSLSITCTVRGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11267 - protein, 119 aa, Artificial Sequence
  Description of Artificial Sequence: Synthetic polypeptide
  Variable HC  S025A
QVQLKQSGPGLVQPSQSLSITCTVAGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11268 - protein, 119 aa, Artificial Sequence
  Description of Artificial Sequence: Synthetic polypeptide
  Variable HC  S025C
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11269 - protein, 119 aa, Artificial Sequence
  Description of Artificial Sequence: Synthetic polypeptide
  Variable HC  S025D
QVQLKQSGPGLVQPSQSLSITCTVDGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11270 - protein, 119 aa, Artificial Sequence
  Description of Artificial Sequence: Synthetic polypeptide
  Variable HC  S025E
QVQLKQSGPGLVQPSQSLSITCTVEGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11271 - protein, 119 aa, Artificial Sequence
  Description of Artificial Sequence: Synthetic polypeptide
  Variable HC  S025F
QVQLKQSGPGLVQPSQSLSITCTVFGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11272 - protein, 119 aa, Artificial Sequence
  Description of Artificial Sequence: Synthetic polypeptide
  Variable HC  S025G
QVQLKQSGPGLVQPSQSLSITCTVGGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11273 - protein, 119 aa, Artificial Sequence
  Description of Artificial Sequence: Synthetic polypeptide
  Variable HC  S025I
QVQLKQSGPGLVQPSQSLSITCTVIGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11274 - protein, 119 aa, Artificial Sequence
  Description of Artificial Sequence: Synthetic polypeptide
  Variable HC  S025M
QVQLKQSGPGLVQPSQSLSITCTVMGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11275 - protein, 119 aa, Artificial Sequence
  Description of Artificial Sequence: Synthetic polypeptide
  Variable HC  S025P
QVQLKQSGPGLVQPSQSLSITCTVPGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11276 - protein, 119 aa, Artificial Sequence
  Description of Artificial Sequence: Synthetic polypeptide
  Variable HC  S025Q
QVQLKQSGPGLVQPSQSLSITCTVQGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11277 - protein, 119 aa, Artificial Sequence
  Description of Artificial Sequence: Synthetic polypeptide
  Variable HC  S025T
QVQLKQSGPGLVQPSQSLSITCTVTGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11278 - protein, 119 aa, Artificial Sequence
  Description of Artificial Sequence: Synthetic polypeptide
  Variable HC  S025V
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11279 - protein, 119 aa, Artificial Sequence
  Description of Artificial Sequence: Synthetic polypeptide
  Variable HC  S025L
QVQLKQSGPGLVQPSQSLSITCTVLGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11280 - protein, 119 aa, Artificial Sequence
  Description of Artificial Sequence: Synthetic polypeptide
  Variable HC  G026H
QVQLKQSGPGLVQPSQSLSITCTVSHFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11281 - protein, 119 aa, Artificial Sequence
  Description of Artificial Sequence: Synthetic polypeptide
  Variable HC  G026R
QVQLKQSGPGLVQPSQSLSITCTVSRFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11282 - protein, 119 aa, Artificial Sequence
  Description of Artificial Sequence: Synthetic polypeptide
  Variable HC  G026D
QVQLKQSGPGLVQPSQSLSITCTVSDFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11283 - protein, 119 aa, Artificial Sequence
  Description of Artificial Sequence: Synthetic polypeptide
  Variable HC  G026F
QVQLKQSGPGLVQPSQSLSITCTVSFFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11284 - protein, 119 aa, Artificial Sequence
  Description of Artificial Sequence: Synthetic polypeptide
  Variable HC  G026M
QVQLKQSGPGLVQPSQSLSITCTVSMFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11285 - protein, 119 aa, Artificial Sequence
  Description of Artificial Sequence: Synthetic polypeptide
  Variable HC  G026N
QVQLKQSGPGLVQPSQSLSITCTVSNFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11286 - protein, 119 aa, Artificial Sequence
  Description of Artificial Sequence: Synthetic polypeptide
  Variable HC  G026P
QVQLKQSGPGLVQPSQSLSITCTVSPFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11287 - protein, 119 aa, Artificial Sequence
  Description of Artificial Sequence: Synthetic polypeptide
  Variable HC  G026Q
QVQLKQSGPGLVQPSQSLSITCTVSQFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11288 - protein, 119 aa, Artificial Sequence
  Description of Artificial Sequence: Synthetic polypeptide
  Variable HC  G026S
QVQLKQSGPGLVQPSQSLSITCTVSSFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11289 - protein, 119 aa, Artificial Sequence
  Description of Artificial Sequence: Synthetic polypeptide
  Variable HC  G026Y
QVQLKQSGPGLVQPSQSLSITCTVSYFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11290 - protein, 119 aa, Artificial Sequence
  Description of Artificial Sequence: Synthetic polypeptide
  Variable HC  G026L
QVQLKQSGPGLVQPSQSLSITCTVSLFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11291 - protein, 119 aa, Artificial Sequence
  Description of Artificial Sequence: Synthetic polypeptide
  Variable HC  F027H
QVQLKQSGPGLVQPSQSLSITCTVSGHSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11292 - protein, 119 aa, Artificial Sequence
  Description of Artificial Sequence: Synthetic polypeptide
  Variable HC  F027R
QVQLKQSGPGLVQPSQSLSITCTVSGRSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11293 - protein, 119 aa, Artificial Sequence
  Description of Artificial Sequence: Synthetic polypeptide
  Variable HC  F027A
QVQLKQSGPGLVQPSQSLSITCTVSGASLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11294 - protein, 119 aa, Artificial Sequence
  Description of Artificial Sequence: Synthetic polypeptide
  Variable HC  F027D
QVQLKQSGPGLVQPSQSLSITCTVSGDSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11295 - protein, 119 aa, Artificial Sequence
  Description of Artificial Sequence: Synthetic polypeptide
  Variable HC  F027E
QVQLKQSGPGLVQPSQSLSITCTVSGESLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11296 - protein, 119 aa, Artificial Sequence
  Description of Artificial Sequence: Synthetic polypeptide
  Variable HC  F027G
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11297 - protein, 119 aa, Artificial Sequence
  Description of Artificial Sequence: Synthetic polypeptide
  Variable HC  F027M
QVQLKQSGPGLVQPSQSLSITCTVSGMSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11298 - protein, 119 aa, Artificial Sequence
  Description of Artificial Sequence: Synthetic polypeptide
  Variable HC  F027P
QVQLKQSGPGLVQPSQSLSITCTVSGPSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11299 - protein, 119 aa, Artificial Sequence
  Description of Artificial Sequence: Synthetic polypeptide
  Variable HC  F027Q
QVQLKQSGPGLVQPSQSLSITCTVSGQSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11300 - protein, 119 aa, Artificial Sequence
  Description of Artificial Sequence: Synthetic polypeptide
  Variable HC  F027S
QVQLKQSGPGLVQPSQSLSITCTVSGSSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11301 - protein, 119 aa, Artificial Sequence
  Description of Artificial Sequence: Synthetic polypeptide
  Variable HC  F027T
QVQLKQSGPGLVQPSQSLSITCTVSGTSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11302 - protein, 119 aa, Artificial Sequence
  Description of Artificial Sequence: Synthetic polypeptide
  Variable HC  F027V
QVQLKQSGPGLVQPSQSLSITCTVSGVSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11303 - protein, 119 aa, Artificial Sequence
  Description of Artificial Sequence: Synthetic polypeptide
  Variable HC  F027W
QVQLKQSGPGLVQPSQSLSITCTVSGWSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11304 - protein, 119 aa, Artificial Sequence
  Description of Artificial Sequence: Synthetic polypeptide
  Variable HC  F027Y
QVQLKQSGPGLVQPSQSLSITCTVSGYSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11305 - protein, 119 aa, Artificial Sequence
  Description of Artificial Sequence: Synthetic polypeptide
  Variable HC  F027L
QVQLKQSGPGLVQPSQSLSITCTVSGLSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11306 - protein, 119 aa, Artificial Sequence
  Description of Artificial Sequence: Synthetic polypeptide
  Variable HC  S028K
QVQLKQSGPGLVQPSQSLSITCTVSGFKLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11307 - protein, 119 aa, Artificial Sequence
  Description of Artificial Sequence: Synthetic polypeptide
  Variable HC  S028H
QVQLKQSGPGLVQPSQSLSITCTVSGFHLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11308 - protein, 119 aa, Artificial Sequence
  Description of Artificial Sequence: Synthetic polypeptide
  Variable HC  S028R
QVQLKQSGPGLVQPSQSLSITCTVSGFRLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11309 - protein, 119 aa, Artificial Sequence
  Description of Artificial Sequence: Synthetic polypeptide
  Variable HC  S028A
QVQLKQSGPGLVQPSQSLSITCTVSGFALTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11310 - protein, 119 aa, Artificial Sequence
  Description of Artificial Sequence: Synthetic polypeptide
  Variable HC S028D
QVQLKQSGPGLVQPSQSLSITCTVSGFDLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11311 - protein, 119 aa, Artificial Sequence
  Description of Artificial Sequence: Synthetic polypeptide
  Variable HC S028I
QVQLKQSGPGLVQPSQSLSITCTVSGFILTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11312 - protein, 119 aa, Artificial Sequence
  Description of Artificial Sequence: Synthetic polypeptide
  Variable HC S028M
QVQLKQSGPGLVQPSQSLSITCTVSGFMLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11313 - protein, 119 aa, Artificial Sequence
  Description of Artificial Sequence: Synthetic polypeptide
  Variable HC S028P
QVQLKQSGPGLVQPSQSLSITCTVSGFPLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11314 - protein, 119 aa, Artificial Sequence
  Description of Artificial Sequence: Synthetic polypeptide
  Variable HC S028Q
QVQLKQSGPGLVQPSQSLSITCTVSGFQLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11315 - protein, 119 aa, Artificial Sequence
  Description of Artificial Sequence: Synthetic polypeptide
  Variable HC S028V
QVQLKQSGPGLVQPSQSLSITCTVSGFVLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11316 - protein, 119 aa, Artificial Sequence
  Description of Artificial Sequence: Synthetic polypeptide
  Variable HC S028W
QVQLKQSGPGLVQPSQSLSITCTVSGFWLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11317 - protein, 119 aa, Artificial Sequence
  Description of Artificial Sequence: Synthetic polypeptide
  Variable HC S028L
QVQLKQSGPGLVQPSQSLSITCTVSGFLLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11318 - protein, 119 aa, Artificial Sequence
  Description of Artificial Sequence: Synthetic polypeptide
  Variable HC L029K
QVQLKQSGPGLVQPSQSLSITCTVSGFSKTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11319 - protein, 119 aa, Artificial Sequence
  Description of Artificial Sequence: Synthetic polypeptide
  Variable HC L029H
QVQLKQSGPGLVQPSQSLSITCTVSGFSHTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11320 - protein, 119 aa, Artificial Sequence
  Description of Artificial Sequence: Synthetic polypeptide
  Variable HC L029A
QVQLKQSGPGLVQPSQSLSITCTVSGFSATNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11321 - protein, 119 aa, Artificial Sequence
  Description of Artificial Sequence: Synthetic polypeptide
  Variable HC L029D
QVQLKQSGPGLVQPSQSLSITCTVSGFSDTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11322 - protein, 119 aa, Artificial Sequence
  Description of Artificial Sequence: Synthetic polypeptide
  Variable HC L029G
QVQLKQSGPGLVQPSQSLSITCTVSGFSGTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11323 - protein, 119 aa, Artificial Sequence
  Description of Artificial Sequence: Synthetic polypeptide
  Variable HC L029I
QVQLKQSGPGLVQPSQSLSITCTVSGFSITNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11324 - protein, 119 aa, Artificial Sequence
  Description of Artificial Sequence: Synthetic polypeptide
  Variable HC L029M
QVQLKQSGPGLVQPSQSLSITCTVSGFSMTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11325 - protein, 119 aa, Artificial Sequence
  Description of Artificial Sequence: Synthetic polypeptide
  Variable HC L029N
QVQLKQSGPGLVQPSQSLSITCTVSGFSNTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11326 - protein, 119 aa, Artificial Sequence
  Description of Artificial Sequence: Synthetic polypeptide
  Variable HC L029S
QVQLKQSGPGLVQPSQSLSITCTVSGFSSTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11327 - protein, 119 aa, Artificial Sequence
  Description of Artificial Sequence: Synthetic polypeptide
  Variable HC L029V
QVQLKQSGPGLVQPSQSLSITCTVSGFSVTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11328 - protein, 119 aa, Artificial Sequence
  Description of Artificial Sequence: Synthetic polypeptide
  Variable HC T030H
QVQLKQSGPGLVQPSQSLSITCTVSGFSLHNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11329 - protein, 119 aa, Artificial Sequence
  Description of Artificial Sequence: Synthetic polypeptide
  Variable HC T030R
QVQLKQSGPGLVQPSQSLSITCTVSGFSLRNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11330 - protein, 119 aa, Artificial Sequence
  Description of Artificial Sequence: Synthetic polypeptide
  Variable HC T030D
QVQLKQSGPGLVQPSQSLSITCTVSGFSLDNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11331 - protein, 119 aa, Artificial Sequence
  Description of Artificial Sequence: Synthetic polypeptide
  Variable HC T030G
QVQLKQSGPGLVQPSQSLSITCTVSGFSLGNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11332 - protein, 119 aa, Artificial Sequence
  Description of Artificial Sequence: Synthetic polypeptide
  Variable HC T030I
QVQLKQSGPGLVQPSQSLSITCTVSGFSLINYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11333 - protein, 119 aa, Artificial Sequence
  Description of Artificial Sequence: Synthetic polypeptide
  Variable HC T030M
QVQLKQSGPGLVQPSQSLSITCTVSGFSLMNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11334 - protein, 119 aa, Artificial Sequence
  Description of Artificial Sequence: Synthetic polypeptide
  Variable HC T030N
QVQLKQSGPGLVQPSQSLSITCTVSGFSLNNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11335 - protein, 119 aa, Artificial Sequence
  Description of Artificial Sequence: Synthetic polypeptide
  Variable HC T030P
QVQLKQSGPGLVQPSQSLSITCTVSGFSLPNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11336 - protein, 119 aa, Artificial Sequence
  Description of Artificial Sequence: Synthetic polypeptide
  Variable HC T030S
QVQLKQSGPGLVQPSQSLSITCTVSGFSLSNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11337 - protein, 119 aa, Artificial Sequence
  Description of Artificial Sequence: Synthetic polypeptide
  Variable HC T030V
QVQLKQSGPGLVQPSQSLSITCTVSGFSLVNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11338 - protein, 119 aa, Artificial Sequence
  Description of Artificial Sequence: Synthetic polypeptide
  Variable HC T030W
QVQLKQSGPGLVQPSQSLSITCTVSGFSLWNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11339 - protein, 119 aa, Artificial Sequence
  Description of Artificial Sequence: Synthetic polypeptide
  Variable HC T030Y
QVQLKQSGPGLVQPSQSLSITCTVSGFSLYNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11340 - protein, 119 aa, Artificial Sequence
  Description of Artificial Sequence: Synthetic polypeptide
  Variable HC N031K
QVQLKQSGPGLVQPSQSLSITCTVSGFSLTKYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11341 - protein, 119 aa, Artificial Sequence
  Description of Artificial Sequence: Synthetic polypeptide
  Variable HC N031H
QVQLKQSGPGLVQPSQSLSITCTVSGFSLTHYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11342 - protein, 119 aa, Artificial Sequence
  Description of Artificial Sequence: Synthetic polypeptide
  Variable HC N031D
QVQLKQSGPGLVQPSQSLSITCTVSGFSLTDYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11343 - protein, 119 aa, Artificial Sequence
  Description of Artificial Sequence: Synthetic polypeptide
  Variable HC N031E
QVQLKQSGPGLVQPSQSLSITCTVSGFSLTEYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11344 - protein, 119 aa, Artificial Sequence
  Description of Artificial Sequence: Synthetic polypeptide
  Variable HC N031G
QVQLKQSGPGLVQPSQSLSITCTVSGFSLTGYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11345 - protein, 119 aa, Artificial Sequence
  Description of Artificial Sequence: Synthetic polypeptide
  Variable HC N031I
QVQLKQSGPGLVQPSQSLSITCTVSGFSLTIYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11346 - protein, 119 aa, Artificial Sequence
  Description of Artificial Sequence: Synthetic polypeptide
  Variable HC N031T
QVQLKQSGPGLVQPSQSLSITCTVSGFSLTTYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11347 - protein, 119 aa, Artificial Sequence
  Description of Artificial Sequence: Synthetic polypeptide
  Variable HC N031V
QVQLKQSGPGLVQPSQSLSITCTVSGFSLTVYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11348 - protein, 119 aa, Artificial Sequence
  Description of Artificial Sequence: Synthetic polypeptide
  Variable HC N031L
QVQLKQSGPGLVQPSQSLSITCTVSGFSLTLYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11349 - protein, 119 aa, Artificial Sequence
  Description of Artificial Sequence: Synthetic polypeptide
  Variable HC Y032H
QVQLKQSGPGLVQPSQSLSITCTVSGFSLTNHGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11350 - protein, 119 aa, Artificial Sequence
  Description of Artificial Sequence: Synthetic polypeptide
  Variable HC Y032R
QVQLKQSGPGLVQPSQSLSITCTVSGFSLTNRGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11351 - protein, 119 aa, Artificial Sequence
  Description of Artificial Sequence: Synthetic polypeptide
  Variable HC Y032C
QVQLKQSGPGLVQPSQSLSITCTVSGFSLTNCGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11352 - protein, 119 aa, Artificial Sequence
  Description of Artificial Sequence: Synthetic polypeptide
  Variable HC Y032M
QVQLKQSGPGLVQPSQSLSITCTVSGFSLTNMGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11353 - protein, 119 aa, Artificial Sequence
  Description of Artificial Sequence: Synthetic polypeptide
  Variable HC Y032N
QVQLKQSGPGLVQPSQSLSITCTVSGFSLTNNGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11354 - protein, 119 aa, Artificial Sequence
  Description of Artificial Sequence: Synthetic polypeptide
  Variable HC Y032T
QVQLKQSGPGLVQPSQSLSITCTVSGFSLTNTGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11355 - protein, 119 aa, Artificial Sequence
  Description of Artificial Sequence: Synthetic polypeptide
  Variable HC Y032V
QVQLKQSGPGLVQPSQSLSITCTVSGFSLTNVGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11356 - protein, 119 aa, Artificial Sequence
  Description of Artificial Sequence: Synthetic polypeptide
  Variable HC Y032L
QVQLKQSGPGLVQPSQSLSITCTVSGFSLTNLGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11357 - protein, 119 aa, Artificial Sequence
  Description of Artificial Sequence: Synthetic polypeptide
  Variable HC G033E
QVQLKQSGPGLVQPSQSLSITCTVSGFSLTNYEVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11358 - protein, 119 aa, Artificial Sequence
  Description of Artificial Sequence: Synthetic polypeptide
  Variable HC G033M
QVQLKQSGPGLVQPSQSLSITCTVSGFSLTNYMVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11359 - protein, 119 aa, Artificial Sequence
  Description of Artificial Sequence: Synthetic polypeptide
  Variable HC G033S
QVQLKQSGPGLVQPSQSLSITCTVSGFSLTNYSVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11360 - protein, 119 aa, Artificial Sequence
  Description of Artificial Sequence: Synthetic polypeptide
  Variable HC G033T
QVQLKQSGPGLVQPSQSLSITCTVSGFSLTNYTVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11361 - protein, 119 aa, Artificial Sequence
  Description of Artificial Sequence: Synthetic polypeptide
  Variable HC G033Y
QVQLKQSGPGLVQPSQSLSITCTVSGFSLTNYYVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11362 - protein, 119 aa, Artificial Sequence
  Description of Artificial Sequence: Synthetic polypeptide
  Variable HC V034A
QVQLKQSGPGLVQPSQSLSITCTVSGFSLTNYGAHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11363 - protein, 119 aa, Artificial Sequence
  Description of Artificial Sequence: Synthetic polypeptide
  Variable HC V034C
QVQLKQSGPGLVQPSQSLSITCTVSGFSLTNYGCHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11364 - protein, 119 aa, Artificial Sequence
  Description of Artificial Sequence: Synthetic polypeptide
  Variable HC V034I
QVQLKQSGPGLVQPSQSLSITCTVSGFSLTNYGIHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11365 - protein, 119 aa, Artificial Sequence
  Description of Artificial Sequence: Synthetic polypeptide
  Variable HC V034M
QVQLKQSGPGLVQPSQSLSITCTVSGFSLTNYGMHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11366 - protein, 119 aa, Artificial Sequence
  Description of Artificial Sequence: Synthetic polypeptide
  Variable HC V034P
QVQLKQSGPGLVQPSQSLSITCTVSGFSLTNYGPHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11367 - protein, 119 aa, Artificial Sequence
  Description of Artificial Sequence: Synthetic polypeptide
  Variable HC V034L
QVQLKQSGPGLVQPSQSLSITCTVSGFSLTNYGLHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11368 - protein, 119 aa, Artificial Sequence
  Description of Artificial Sequence: Synthetic polypeptide
  Variable HC H035I
QVQLKQSGPGLVQPSQSLSITCTVSGFSLTNYGVIWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11369 - protein, 119 aa, Artificial Sequence
  Description of Artificial Sequence: Synthetic polypeptide
  Variable HC H035Q
QVQLKQSGPGLVQPSQSLSITCTVSGFSLTNYGVQWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11370 - protein, 119 aa, Artificial Sequence
  Description of Artificial Sequence: Synthetic polypeptide
  Variable HC W036K
QVQLKQSGPGLVQPSQSLSITCTVSGFSLTNYGVHKVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11371 - protein, 119 aa, Artificial Sequence
  Description of Artificial Sequence: Synthetic polypeptide
  Variable HC W036A
QVQLKQSGPGLVQPSQSLSITCTVSGFSLTNYGVHAVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11372 - protein, 119 aa, Artificial Sequence
  Description of Artificial Sequence: Synthetic polypeptide
  Variable HC W036I
QVQLKQSGPGLVQPSQSLSITCTVSGFSLTNYGVHIVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11373 - protein, 119 aa, Artificial Sequence
  Description of Artificial Sequence: Synthetic polypeptide
  Variable HC W036V
QVQLKQSGPGLVQPSQSLSITCTVSGFSLTNYGVHVVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11374 - protein, 119 aa, Artificial Sequence
  Description of Artificial Sequence: Synthetic polypeptide
  Variable HC W036Y
QVQLKQSGPGLVQPSQSLSITCTVSGFSLTNYGVHYVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11375 - protein, 119 aa, Artificial Sequence
  Description of Artificial Sequence: Synthetic polypeptide
  Variable HC V050K
QVQLKQSGPGLVQPSQSLSITCTVSGFSLTNYGVHWVRQSPGKGLEWLGKIWSGGNTDYNTPFTSRLSINKDNSKSQVFFKMNSLQSNDTAIYYCARALTYYDYEFAYWGQGTLVTVSA

SEQ ID NO: 11376 - protein, 119 aa, Artificial Sequence
  Description of Artificial Sequence: Synthetic polypeptide
  Variable HC V050H
QVQLKQSGPGLVQPSQSLSITCTVSGFSLTNYGVHWVRQSPGKGLEWLGHIWSGGNTDYNTPFTSRLSINKDNSKSQVFFKMNSLQSNDTAIYYCARALTYYDYEFAYWGQGTLVTVSA

SEQ ID NO: 11377 - protein, 119 aa, Artificial Sequence
  Description of Artificial Sequence: Synthetic polypeptide
  Variable HC V050A
QVQLKQSGPGLVQPSQSLSITCTVSGFSLTNYGVHWVRQSPGKGLEWLGAIWSGGNTDYNTPFTSRLSINKDNSKSQVFFKMNSLQSNDTAIYYCARALTYYDYEFAYWGQGTLVTVSA

SEQ ID NO: 11378 - protein, 119 aa, Artificial Sequence
  Description of Artificial Sequence: Synthetic polypeptide
  Variable HC V050D
QVQLKQSGPGLVQPSQSLSITCTVSGFSLTNYGVHWVRQSPGKGLEWLGDIWSGGNTDYNTPFTSRLSINKDNSKSQVFFKMNSLQSNDTAIYYCARALTYYDYEFAYWGQGTLVTVSA

SEQ ID NO: 11379 - protein, 119 aa, Artificial Sequence
  Description of Artificial Sequence: Synthetic polypeptide
  Variable HC V050E
QVQLKQSGPGLVQPSQSLSITCTVSGFSLTNYGVHWVRQSPGKGLEWLGEIWSGGNTDYNTPFTSRLSINKDNSKSQVFFKMNSLQSNDTAIYYCARALTYYDYEFAYWGQGTLVTVSA

SEQ ID NO: 11380 - protein, 119 aa, Artificial Sequence
  Description of Artificial Sequence: Synthetic polypeptide
  Variable HC V050G
QVQLKQSGPGLVQPSQSLSITCTVSGFSLTNYGVHWVRQSPGKGLEWLGGIWSGGNTDYNTPFTSRLSINKDNSKSQVFFKMNSLQSNDTAIYYCARALTYYDYEFAYWGQGTLVTVSA

SEQ ID NO: 11381 - protein, 119 aa, Artificial Sequence
  Description of Artificial Sequence: Synthetic polypeptide
  Variable HC V050I
QVQLKQSGPGLVQPSQSLSITCTVSGFSLTNYGVHWVRQSPGKGLEWLGIIWSGGNTDYNTPFTSRLSINKDNSKSQVFFKMNSLQSNDTAIYYCARALTYYDYEFAYWGQGTLVTVSA

SEQ ID NO: 11382 - protein, 119 aa, Artificial Sequence
  Description of Artificial Sequence: Synthetic polypeptide
  Variable HC V050N
QVQLKQSGPGLVQPSQSLSITCTVSGFSLTNYGVHWVRQSPGKGLEWLGNIWSGGNTDYNTPFTSRLSINKDNSKSQVFFKMNSLQSNDTAIYYCARALTYYDYEFAYWGQGTLVTVSA

SEQ ID NO: 11383 - protein, 119 aa, Artificial Sequence
  Description of Artificial Sequence: Synthetic polypeptide
  Variable HC V050Q
QVQLKQSGPGLVQPSQSLSITCTVSGFSLTNYGVHWVRQSPGKGLEWLGQIWSGGNTDYNTPFTSRLSINKDNSKSQVFFKMNSLQSNDTAIYYCARALTYYDYEFAYWGQGTLVTVSA

SEQ ID NO: 11384 - protein, 119 aa, Artificial Sequence
  Description of Artificial Sequence: Synthetic polypeptide
  Variable HC V050T
QVQLKQSGPGLVQPSQSLSITCTVSGFSLTNYGVHWVRQSPGKGLEWLGTIWSGGNTDYNTPFTSRLSINKDNSKSQVFFKMNSLQSNDTAIYYCARALTYYDYEFAYWGQGTLVTVSA

SEQ ID NO: 11385 - protein, 119 aa, Artificial Sequence
  Description of Artificial Sequence: Synthetic polypeptide
  Variable HC V050L
QVQLKQSGPGLVQPSQSLSITCTVSGFSLTNYGVHWVRQSPGKGLEWLGLIWSGGNTDYNTPFTSRLSINKDNSKSQVFFKMNSLQSNDTAIYYCARALTYYDYEFAYWGQGTLVTVSA

SEQ ID NO: 11386 - protein, 119 aa, Artificial Sequence
  Description of Artificial Sequence: Synthetic polypeptide
  Variable HC I051K
QVQLKQSGPGLVQPSQSLSITCTVSGFSLTNYGVHWVRQSPGKGLEWLGVKWSGGNTDYNTPFTSRLSINKDNSKSQVFFKMNSLQSNDTAIYYCARALTYYDYEFAYWGQGTLVTVSA

SEQ ID NO: 11387 - protein, 119 aa, Artificial Sequence
  Description of Artificial Sequence: Synthetic polypeptide
  Variable HC I051H
QVQLKQSGPGLVQPSQSLSITCTVSGFSLTNYGVHWVRQSPGKGLEWLGVHWSGGNTDYNTPFTSRLSINKDNSKSQVFFKMNSLQSNDTAIYYCARALTYYDYEFAYWGQGTLVTVSA

SEQ ID NO: 11388 - protein, 119 aa, Artificial Sequence
  Description of Artificial Sequence: Synthetic polypeptide
  Variable HC I051A
QVQLKQSGPGLVQPSQSLSITCTVSGFSLTNYGVHWVRQSPGKGLEWLGVAWSGGNTDYNTPFTSRLSINKDNSKSQVFFKMNSLQSNDTAIYYCARALTYYDYEFAYWGQGTLVTVSA

SEQ ID NO: 11389 - protein, 119 aa, Artificial Sequence
  Description of Artificial Sequence: Synthetic polypeptide
  Variable HC I051C
QVQLKQSGPGLVQPSQSLSITCTVSGFSLTNYGVHWVRQSPGKGLEWLGVCWSGGNTDYNTPFTSRLSINKDNSKSQVFFKMNSLQSNDTAIYYCARALTYYDYEFAYWGQGTLVTVSA

SEQ ID NO: 11390 - protein, 119 aa, Artificial Sequence
  Description of Artificial Sequence: Synthetic polypeptide
  Variable HC I051E
QVQLKQSGPGLVQPSQSLSITCTVSGFSLTNYGVHWVRQSPGKGLEWLGVEWSGGNTDYNTPFTSRLSINKDNSKSQVFFKMNSLQSNDTAIYYCARALTYYDYEFAYWGQGTLVTVSA

SEQ ID NO: 11391 - protein, 119 aa, Artificial Sequence
  Description of Artificial Sequence: Synthetic polypeptide
  Variable HC I051G
QVQLKQSGPGLVQPSQSLSITCTVSGFSLTNYGVHWVRQSPGKGLEWLGVGWSGGNTDYNTPFTSRLSINKDNSKSQVFFKMNSLQSNDTAIYYCARALTYYDYEFAYWGQGTLVTVSA

SEQ ID NO: 11392 - protein, 119 aa, Artificial Sequence
  Description of Artificial Sequence: Synthetic polypeptide
  Variable HC I051N
QVQLKQSGPGLVQPSQSLSITCTVSGFSLTNYGVHWVRQSPGKGLEWLGVNWSGGNTDYNTPFTSRLSINKDNSKSQVFFKMNSLQSNDTAIYYCARALTYYDYEFAYWGQGTLVTVSA

SEQ ID NO: 11393 - protein, 119 aa, Artificial Sequence
  Description of Artificial Sequence: Synthetic polypeptide
  Variable HC I051Q
QVQLKQSGPGLVQPSQSLSITCTVSGFSLTNYGVHWVRQSPGKGLEWLGVQWSGGNTDYNTPFTSRLSINKDNSKSQVFFKMNSLQSNDTAIYYCARALTYYDYEFAYWGQGTLVTVSA

SEQ ID NO: 11394 - protein, 119 aa, Artificial Sequence
  Description of Artificial Sequence: Synthetic polypeptide
  Variable HC I051S
QVQLKQSGPGLVQPSQSLSITCTVSGFSLTNYGVHWVRQSPGKGLEWLGVSWSGGNTDYNTPFTSRLSINKDNSKSQVFFKMNSLQSNDTAIYYCARALTYYDYEFAYWGQGTLVTVSA

SEQ ID NO: 11395 - protein, 119 aa, Artificial Sequence
  Description of Artificial Sequence: Synthetic polypeptide
  Variable HC I051V
QVQLKQSGPGLVQPSQSLSITCTVSGFSLTNYGVHWVRQSPGKGLEWLGVVWSGGNTDYNTPFTSRLSINKDNSKSQVFFKMNSLQSNDTAIYYCARALTYYDYEFAYWGQGTLVTVSA

SEQ ID NO: 11396 - protein, 119 aa, Artificial Sequence
  Description of Artificial Sequence: Synthetic polypeptide
  Variable HC I051Y
QVQLKQSGPGLVQPSQSLSITCTVSGFSLTNYGVHWVRQSPGKGLEWLGVYWSGGNTDYNTPFTSRLSINKDNSKSQVFFKMNSLQSNDTAIYYCARALTYYDYEFAYWGQGTLVTVSA

SEQ ID NO: 11397 - protein, 119 aa, Artificial Sequence
  Description of Artificial Sequence: Synthetic polypeptide
  Variable HC I051L
QVQLKQSGPGLVQPSQSLSITCTVSGFSLTNYGVHWVRQSPGKGLEWLGVLWSGGNTDYNTPFTSRLSINKDNSKSQVFFKMNSLQSNDTAIYYCARALTYYDYEFAYWGQGTLVTVSA

SEQ ID NO: 11398 - protein, 119 aa, Artificial Sequence
  Description of Artificial Sequence: Synthetic polypeptide
  Variable HC W052I
QVQLKQSGPGLVQPSQSLSITCTVSGFSLTNYGVHWVRQSPGKGLEWLGVIISGGNTDYNTPFTSRLSINKDNSKSQVFFKMNSLQSNDTAIYYCARALTYYDYEFAYWGQGTLVTVSA

SEQ ID NO: 11399 - protein, 119 aa, Artificial Sequence
  Description of Artificial Sequence: Synthetic polypeptide
  Variable HC W052N
QVQLKQSGPGLVQPSQSLSITCTVSGFSLTNYGVHWVRQSPGKGLEWLGVINSGGNTDYNTPFTSRLSINKDNSKSQVFFKMNSLQSNDTAIYYCARALTYYDYEFAYWGQGTLVTVSA

SEQ ID NO: 11400 - protein, 119 aa, Artificial Sequence
  Description of Artificial Sequence: Synthetic polypeptide
  Variable HC W052Y
QVQLKQSGPGLVQPSQSLSITCTVSGFSLTNYGVHWVRQSPGKGLEWLGVIYSGGNTDYNTPFTSRLSINKDNSKSQVFFKMNSLQSNDTAIYYCARALTYYDYEFAYWGQGTLVTVSA

SEQ ID NO: 11401 - protein, 119 aa, Artificial Sequence
  Description of Artificial Sequence: Synthetic polypeptide
  Variable HC S053H
QVQLKQSGPGLVQPSQSLSITCTVSGFSLTNYGVHWVRQSPGKGLEWLGVIWHGGNTDYNTPFTSRLSINKDNSKSQVFFKMNSLQSNDTAIYYCARALTYYDYEFAYWGQGTLVTVSA

SEQ ID NO: 11402 - protein, 119 aa, Artificial Sequence
  Description of Artificial Sequence: Synthetic polypeptide
  Variable HC S053R
QVQLKQSGPGLVQPSQSLSITCTVSGFSLTNYGVHWVRQSPGKGLEWLGVIWRGGNTDYNTPFTSRLSINKDNSKSQVFFKMNSLQSNDTAIYYCARALTYYDYEFAYWGQGTLVTVSA

SEQ ID NO: 11403 - protein, 119 aa, Artificial Sequence
  Description of Artificial Sequence: Synthetic polypeptide
  Variable HC S053A
QVQLKQSGPGLVQPSQSLSITCTVSGFSLTNYGVHWVRQSPGKGLEWLGVIWAGGNTDYNTPFTSRLSINKDNSKSQVFFKMNSLQSNDTAIYYCARALTYYDYEFAYWGQGTLVTVSA

SEQ ID NO: 11404 - protein, 119 aa, Artificial Sequence
  Description of Artificial Sequence: Synthetic polypeptide
  Variable HC S053C
QVQLKQSGPGLVQPSQSLSITCTVSGFSLTNYGVHWVRQSPGKGLEWLGVIWCGGNTDYNTPFTSRLSINKDNSKSQVFFKMNSLQSNDTAIYYCARALTYYDYEFAYWGQGTLVTVSA

SEQ ID NO: 11405 - protein, 119 aa, Artificial Sequence
  Description of Artificial Sequence: Synthetic polypeptide
  Variable HC S053G
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDYEFAYWGQGTLVTVSA

SEQ ID NO: 11406 - protein, 119 aa, Artificial Sequence
  Description of Artificial Sequence: Synthetic polypeptide
  Variable HC S053I
QVQLKQSGPGLVQPSQSLSITCTVSGFSLTNYGVHWVRQSPGKGLEWLGVIWIGGNTDYNTPFTSRLSINKDNSKSQVFFKMNSLQSNDTAIYYCARALTYYDYEFAYWGQGTLVTVSA

SEQ ID NO: 11407 - protein, 119 aa, Artificial Sequence
  Description of Artificial Sequence: Synthetic polypeptide
  Variable HC S053M
QVQLKQSGPGLVQPSQSLSITCTVSGFSLTNYGVHWVRQSPGKGLEWLGVIWMGGNTDYNTPFTSRLSINKDNSKSQVFFKMNSLQSNDTAIYYCARALTYYDYEFAYWGQGTLVTVSA

SEQ ID NO: 11408 - protein, 119 aa, Artificial Sequence
  Description of Artificial Sequence: Synthetic polypeptide
  Variable HC S053P
QVQLKQSGPGLVQPSQSLSITCTVSGFSLTNYGVHWVRQSPGKGLEWLGVIWPGGNTDYNTPFTSRLSINKDNSKSQVFFKMNSLQSNDTAIYYCARALTYYDYEFAYWGQGTLVTVSA

SEQ ID NO: 11409 - protein, 119 aa, Artificial Sequence
  Description of Artificial Sequence: Synthetic polypeptide
  Variable HC S053Q
QVQLKQSGPGLVQPSQSLSITCTVSGFSLTNYGVHWVRQSPGKGLEWLGVIWQGGNTDYNTPFTSRLSINKDNSKSQVFFKMNSLQSNDTAIYYCARALTYYDYEFAYWGQGTLVTVSA

SEQ ID NO: 11410 - protein, 119 aa, Artificial Sequence
  Description of Artificial Sequence: Synthetic polypeptide
  Variable HC S053L
QVQLKQSGPGLVQPSQSLSITCTVSGFSLTNYGVHWVRQSPGKGLEWLGVIWLGGNTDYNTPFTSRLSINKDNSKSQVFFKMNSLQSNDTAIYYCARALTYYDYEFAYWGQGTLVTVSA

SEQ ID NO: 11411 - protein, 119 aa, Artificial Sequence
  Description of Artificial Sequence: Synthetic polypeptide
  Variable HC S053T
QVQLKQSGPGLVQPSQSLSITCTVSGFSLTNYGVHWVRQSPGKGLEWLGVIWTGGNTDYNTPFTSRLSINKDNSKSQVFFKMNSLQSNDTAIYYCARALTYYDYEFAYWGQGTLVTVSA

SEQ ID NO: 11412 - protein, 119 aa, Artificial Sequence
  Description of Artificial Sequence: Synthetic polypeptide
  Variable HC S053V
QVQLKQSGPGLVQPSQSLSITCTVSGFSLTNYGVHWVRQSPGKGLEWLGVIWVGGNTDYNTPFTSRLSINKDNSKSQVFFKMNSLQSNDTAIYYCARALTYYDYEFAYWGQGTLVTVSA

SEQ ID NO: 11413 - protein, 119 aa, Artificial Sequence
  Description of Artificial Sequence: Synthetic polypeptide
  Variable HC S053Y
QVQLKQSGPGLVQPSQSLSITCTVSGFSLTNYGVHWVRQSPGKGLEWLGVIWYGGNTDYNTPFTSRLSINKDNSKSQVFFKMNSLQSNDTAIYYCARALTYYDYEFAYWGQGTLVTVSA

SEQ ID NO: 11414 - protein, 119 aa, Artificial Sequence
  Description of Artificial Sequence: Synthetic polypeptide
  Variable HC G054H
QVQLKQSGPGLVQPSQSLSITCTVSGFSLTNYGVHWVRQSPGKGLEWLGVIWSHGNTDYNTPFTSRLSINKDNSKSQVFFKMNSLQSNDTAIYYCARALTYYDYEFAYWGQGTLVTVSA

SEQ ID NO: 11415 - protein, 119 aa, Artificial Sequence
  Description of Artificial Sequence: Synthetic polypeptide
  Variable HC G054R
QVQLKQSGPGLVQPSQSLSITCTVSGFSLTNYGVHWVRQSPGKGLEWLGVIWSRGNTDYNTPFTSRLSINKDNSKSQVFFKMNSLQSNDTAIYYCARALTYYDYEFAYWGQGTLVTVSA

SEQ ID NO: 11416 - protein, 119 aa, Artificial Sequence
  Description of Artificial Sequence: Synthetic polypeptide
  Variable HC G054A
QVQLKQSGPGLVQPSQSLSITCTVSGFSLTNYGVHWVRQSPGKGLEWLGVIWSAGNTDYNTPFTSRLSINKDNSKSQVFFKMNSLQSNDTAIYYCARALTYYDYEFAYWGQGTLVTVSA

SEQ ID NO: 11417 - protein, 119 aa, Artificial Sequence
  Description of Artificial Sequence: Synthetic polypeptide
  Variable HC G054C
QVQLKQSGPGLVQPSQSLSITCTVSGFSLTNYGVHWVRQSPGKGLEWLGVIWSCGNTDYNTPFTSRLSINKDNSKSQVFFKMNSLQSNDTAIYYCARALTYYDYEFAYWGQGTLVTVSA

SEQ ID NO: 11418 - protein, 119 aa, Artificial Sequence
  Description of Artificial Sequence: Synthetic polypeptide
  Variable HC G054D
QVQLKQSGPGLVQPSQSLSITCTVSGFSLTNYGVHWVRQSPGKGLEWLGVIWSDGNTDYNTPFTSRLSINKDNSKSQVFFKMNSLQSNDTAIYYCARALTYYDYEFAYWGQGTLVTVSA

SEQ ID NO: 11419 - protein, 119 aa, Artificial Sequence
  Description of Artificial Sequence: Synthetic polypeptide
  Variable HC G054P
QVQLKQSGPGLVQPSQSLSITCTVSGFSLTNYGVHWVRQSPGKGLEWLGVIWSPGNTDYNTPFTSRLSINKDNSKSQVFFKMNSLQSNDTAIYYCARALTYYDYEFAYWGQGTLVTVSA

SEQ ID NO: 11420 - protein, 119 aa, Artificial Sequence
  Description of Artificial Sequence: Synthetic polypeptide
  Variable HC G054S
QVQLKQSGPGLVQPSQSLSITCTVSGFSLTNYGVHWVRQSPGKGLEWLGVIWSSGNTDYNTPFTSRLSINKDNSKSQVFFKMNSLQSNDTAIYYCARALTYYDYEFAYWGQGTLVTVSA

SEQ ID NO: 11421 - protein, 119 aa, Artificial Sequence
  Description of Artificial Sequence: Synthetic polypeptide
  Variable HC G055H
QVQLKQSGPGLVQPSQSLSITCTVSGFSLTNYGVHWVRQSPGKGLEWLGVIWSGHNTDYNTPFTSRLSINKDNSKSQVFFKMNSLQSNDTAIYYCARALTYYDYEFAYWGQGTLVTVSA

SEQ ID NO: 11422 - protein, 119 aa, Artificial Sequence
  Description of Artificial Sequence: Synthetic polypeptide
  Variable HC G055R
QVQLKQSGPGLVQPSQSLSITCTVSGFSLTNYGVHWVRQSPGKGLEWLGVIWSGRNTDYNTPFTSRLSINKDNSKSQVFFKMNSLQSNDTAIYYCARALTYYDYEFAYWGQGTLVTVSA

SEQ ID NO: 11423 - protein, 119 aa, Artificial Sequence
  Description of Artificial Sequence: Synthetic polypeptide
  Variable HC G055M
QVQLKQSGPGLVQPSQSLSITCTVSGFSLTNYGVHWVRQSPGKGLEWLGVIWSGMNTDYNTPFTSRLSINKDNSKSQVFFKMNSLQSNDTAIYYCARALTYYDYEFAYWGQGTLVTVSA

SEQ ID NO: 11424 - protein, 119 aa, Artificial Sequence
  Description of Artificial Sequence: Synthetic polypeptide
  Variable HC G055S
QVQLKQSGPGLVQPSQSLSITCTVSGFSLTNYGVHWVRQSPGKGLEWLGVIWSGSNTDYNTPFTSRLSINKDNSKSQVFFKMNSLQSNDTAIYYCARALTYYDYEFAYWGQGTLVTVSA

SEQ ID NO: 11425 - protein, 119 aa, Artificial Sequence
  Description of Artificial Sequence: Synthetic polypeptide
  Variable HC G055Y
QVQLKQSGPGLVQPSQSLSITCTVSGFSLTNYGVHWVRQSPGKGLEWLGVIWSGYNTDYNTPFTSRLSINKDNSKSQVFFKMNSLQSNDTAIYYCARALTYYDYEFAYWGQGTLVTVSA

SEQ ID NO: 11426 - protein, 119 aa, Artificial Sequence
  Description of Artificial Sequence: Synthetic polypeptide
  Variable HC N056K
QVQLKQSGPGLVQPSQSLSITCTVSGFSLTNYGVHWVRQSPGKGLEWLGVIWSGGKTDYNTPFTSRLSINKDNSKSQVFFKMNSLQSNDTAIYYCARALTYYDYEFAYWGQGTLVTVSA

SEQ ID NO: 11427 - protein, 119 aa, Artificial Sequence
  Description of Artificial Sequence: Synthetic polypeptide
  Variable HC N056A
QVQLKQSGPGLVQPSQSLSITCTVSGFSLTNYGVHWVRQSPGKGLEWLGVIWSGGATDYNTPFTSRLSINKDNSKSQVFFKMNSLQSNDTAIYYCARALTYYDYEFAYWGQGTLVTVSA

SEQ ID NO: 11428 - protein, 119 aa, Artificial Sequence
  Description of Artificial Sequence: Synthetic polypeptide
  Variable HC N056P
QVQLKQSGPGLVQPSQSLSITCTVSGFSLTNYGVHWVRQSPGKGLEWLGVIWSGGPTDYNTPFTSRLSINKDNSKSQVFFKMNSLQSNDTAIYYCARALTYYDYEFAYWGQGTLVTVSA

SEQ ID NO: 11429 - protein, 119 aa, Artificial Sequence
  Description of Artificial Sequence: Synthetic polypeptide
  Variable HC N056S
QVQLKQSGPGLVQPSQSLSITCTVSGFSLTNYGVHWVRQSPGKGLEWLGVIWSGGSTDYNTPFTSRLSINKDNSKSQVFFKMNSLQSNDTAIYYCARALTYYDYEFAYWGQGTLVTVSA

SEQ ID NO: 11430 - protein, 119 aa, Artificial Sequence
  Description of Artificial Sequence: Synthetic polypeptide
  Variable HC N056V
QVQLKQSGPGLVQPSQSLSITCTVSGFSLTNYGVHWVRQSPGKGLEWLGVIWSGGVTDYNTPFTSRLSINKDNSKSQVFFKMNSLQSNDTAIYYCARALTYYDYEFAYWGQGTLVTVSA

SEQ ID NO: 11431 - protein, 119 aa, Artificial Sequence
  Description of Artificial Sequence: Synthetic polypeptide
  Variable HC N056G
QVQLKQSGPGLVQPSQSLSITCTVSGFSLTNYGVHWVRQSPGKGLEWLGVIWSGGGTDYNTPFTSRLSINKDNSKSQVFFKMNSLQSNDTAIYYCARALTYYDYEFAYWGQGTLVTVSA

SEQ ID NO: 11432 - protein, 119 aa, Artificial Sequence
  Description of Artificial Sequence: Synthetic polypeptide
  Variable HC T057H
QVQLKQSGPGLVQPSQSLSITCTVSGFSLTNYGVHWVRQSPGKGLEWLGVIWSGGNHDYNTPFTSRLSINKDNSKSQVFFKMNSLQSNDTAIYYCARALTYYDYEFAYWGQGTLVTVSA

SEQ ID NO: 11433 - protein, 119 aa, Artificial Sequence
  Description of Artificial Sequence: Synthetic polypeptide
  Variable HC T057R
QVQLKQSGPGLVQPSQSLSITCTVSGFSLTNYGVHWVRQSPGKGLEWLGVIWSGGNRDYNTPFTSRLSINKDNSKSQVFFKMNSLQSNDTAIYYCARALTYYDYEFAYWGQGTLVTVSA

SEQ ID NO: 11434 - protein, 119 aa, Artificial Sequence
  Description of Artificial Sequence: Synthetic polypeptide
  Variable HC T057L
QVQLKQSGPGLVQPSQSLSITCTVSGFSLTNYGVHWVRQSPGKGLEWLGVIWSGGNLDYNTPFTSRLSINKDNSKSQVFFKMNSLQSNDTAIYYCARALTYYDYEFAYWGQGTLVTVSA

SEQ ID NO: 11435 - protein, 119 aa, Artificial Sequence
  Description of Artificial Sequence: Synthetic polypeptide
  Variable HC T057A
QVQLKQSGPGLVQPSQSLSITCTVSGFSLTNYGVHWVRQSPGKGLEWLGVIWSGGNADYNTPFTSRLSINKDNSKSQVFFKMNSLQSNDTAIYYCARALTYYDYEFAYWGQGTLVTVSA

SEQ ID NO: 11436 - protein, 119 aa, Artificial Sequence
  Description of Artificial Sequence: Synthetic polypeptide
  Variable HC T057C
QVQLKQSGPGLVQPSQSLSITCTVSGFSLTNYGVHWVRQSPGKGLEWLGVIWSGGNCDYNTPFTSRLSINKDNSKSQVFFKMNSLQSNDTAIYYCARALTYYDYEFAYWGQGTLVTVSA

SEQ ID NO: 11437 - protein, 119 aa, Artificial Sequence
  Description of Artificial Sequence: Synthetic polypeptide
  Variable HC T057D
QVQLKQSGPGLVQPSQSLSITCTVSGFSLTNYGVHWVRQSPGKGLEWLGVIWSGGNDDYNTPFTSRLSINKDNSKSQVFFKMNSLQSNDTAIYYCARALTYYDYEFAYWGQGTLVTVSA

SEQ ID NO: 11438 - protein, 119 aa, Artificial Sequence
  Description of Artificial Sequence: Synthetic polypeptide
  Variable HC T057F
QVQLKQSGPGLVQPSQSLSITCTVSGFSLTNYGVHWVRQSPGKGLEWLGVIWSGGNFDYNTPFTSRLSINKDNSKSQVFFKMNSLQSNDTAIYYCARALTYYDYEFAYWGQGTLVTVSA

SEQ ID NO: 11439 - protein, 119 aa, Artificial Sequence
  Description of Artificial Sequence: Synthetic polypeptide
  Variable HC T057M
QVQLKQSGPGLVQPSQSLSITCTVSGFSLTNYGVHWVRQSPGKGLEWLGVIWSGGNMDYNTPFTSRLSINKDNSKSQVFFKMNSLQSNDTAIYYCARALTYYDYEFAYWGQGTLVTVSA

SEQ ID NO: 11440 - protein, 119 aa, Artificial Sequence
  Description of Artificial Sequence: Synthetic polypeptide
  Variable HC T057N
QVQLKQSGPGLVQPSQSLSITCTVSGFSLTNYGVHWVRQSPGKGLEWLGVIWSGGNNDYNTPFTSRLSINKDNSKSQVFFKMNSLQSNDTAIYYCARALTYYDYEFAYWGQGTLVTVSA

SEQ ID NO: 11441 - protein, 119 aa, Artificial Sequence
  Description of Artificial Sequence: Synthetic polypeptide
  Variable HC T057Q
QVQLKQSGPGLVQPSQSLSITCTVSGFSLTNYGVHWVRQSPGKGLEWLGVIWSGGNQDYNTPFTSRLSINKDNSKSQVFFKMNSLQSNDTAIYYCARALTYYDYEFAYWGQGTLVTVSA

SEQ ID NO: 11442 - protein, 119 aa, Artificial Sequence
  Description of Artificial Sequence: Synthetic polypeptide
  Variable HC T057W
QVQLKQSGPGLVQPSQSLSITCTVSGFSLTNYGVHWVRQSPGKGLEWLGVIWSGGNWDYNTPFTSRLSINKDNSKSQVFFKMNSLQSNDTAIYYCARALTYYDYEFAYWGQGTLVTVSA

SEQ ID NO: 11443 - protein, 119 aa, Artificial Sequence
  Description of Artificial Sequence: Synthetic polypeptide
  Variable HC T057Y
QVQLKQSGPGLVQPSQSLSITCTVSGFSLTNYGVHWVRQSPGKGLEWLGVIWSGGNYDYNTPFTSRLSINKDNSKSQVFFKMNSLQSNDTAIYYCARALTYYDYEFAYWGQGTLVTVSA

SEQ ID NO: 11444 - protein, 119 aa, Artificial Sequence
  Description of Artificial Sequence: Synthetic polypeptide
  Variable HC D058L
QVQLKQSGPGLVQPSQSLSITCTVSGFSLTNYGVHWVRQSPGKGLEWLGVIWSGGNTLYNTPFTSRLSINKDNSKSQVFFKMNSLQSNDTAIYYCARALTYYDYEFAYWGQGTLVTVSA

SEQ ID NO: 11445 - protein, 119 aa, Artificial Sequence
  Description of Artificial Sequence: Synthetic polypeptide
  Variable HC D058G
QVQLKQSGPGLVQPSQSLSITCTVSGFSLTNYGVHWVRQSPGKGLEWLGVIWSGGNTGYNTPFTSRLSINKDNSKSQVFFKMNSLQSNDTAIYYCARALTYYDYEFAYWGQGTLVTVSA

SEQ ID NO: 11446 - protein, 119 aa, Artificial Sequence
  Description of Artificial Sequence: Synthetic polypeptide
  Variable HC D058M
QVQLKQSGPGLVQPSQSLSITCTVSGFSLTNYGVHWVRQSPGKGLEWLGVIWSGGNTMYNTPFTSRLSINKDNSKSQVFFKMNSLQSNDTAIYYCARALTYYDYEFAYWGQGTLVTVSA

SEQ ID NO: 11447 - protein, 119 aa, Artificial Sequence
  Description of Artificial Sequence: Synthetic polypeptide
  Variable HC D058N
QVQLKQSGPGLVQPSQSLSITCTVSGFSLTNYGVHWVRQSPGKGLEWLGVIWSGGNTNYNTPFTSRLSINKDNSKSQVFFKMNSLQSNDTAIYYCARALTYYDYEFAYWGQGTLVTVSA

SEQ ID NO: 11448 - protein, 119 aa, Artificial Sequence
  Description of Artificial Sequence: Synthetic polypeptide
  Variable HC D058Q
QVQLKQSGPGLVQPSQSLSITCTVSGFSLTNYGVHWVRQSPGKGLEWLGVIWSGGNTQYNTPFTSRLSINKDNSKSQVFFKMNSLQSNDTAIYYCARALTYYDYEFAYWGQGTLVTVSA

SEQ ID NO: 11449 - protein, 119 aa, Artificial Sequence
  Description of Artificial Sequence: Synthetic polypeptide
  Variable HC Y059H
QVQLKQSGPGLVQPSQSLSITCTVSGFSLTNYGVHWVRQSPGKGLEWLGVIWSGGNTDHNTPFTSRLSINKDNSKSQVFFKMNSLQSNDTAIYYCARALTYYDYEFAYWGQGTLVTVSA

SEQ ID NO: 11450 - protein, 119 aa, Artificial Sequence
  Description of Artificial Sequence: Synthetic polypeptide
  Variable HC Y059R
QVQLKQSGPGLVQPSQSLSITCTVSGFSLTNYGVHWVRQSPGKGLEWLGVIWSGGNTDRNTPFTSRLSINKDNSKSQVFFKMNSLQSNDTAIYYCARALTYYDYEFAYWGQGTLVTVSA

SEQ ID NO: 11451 - protein, 119 aa, Artificial Sequence
  Description of Artificial Sequence: Synthetic polypeptide
  Variable HC Y059A
QVQLKQSGPGLVQPSQSLSITCTVSGFSLTNYGVHWVRQSPGKGLEWLGVIWSGGNTDANTPFTSRLSINKDNSKSQVFFKMNSLQSNDTAIYYCARALTYYDYEFAYWGQGTLVTVSA

SEQ ID NO: 11452 - protein, 119 aa, Artificial Sequence
  Description of Artificial Sequence: Synthetic polypeptide
  Variable HC Y059C
QVQLKQSGPGLVQPSQSLSITCTVSGFSLTNYGVHWVRQSPGKGLEWLGVIWSGGNTDCNTPFTSRLSINKDNSKSQVFFKMNSLQSNDTAIYYCARALTYYDYEFAYWGQGTLVTVSA

SEQ ID NO: 11453 - protein, 119 aa, Artificial Sequence
  Description of Artificial Sequence: Synthetic polypeptide
  Variable HC Y059D
QVQLKQSGPGLVQPSQSLSITCTVSGFSLTNYGVHWVRQSPGKGLEWLGVIWSGGNTDDNTPFTSRLSINKDNSKSQVFFKMNSLQSNDTAIYYCARALTYYDYEFAYWGQGTLVTVSA

SEQ ID NO: 11454 - protein, 119 aa, Artificial Sequence
  Description of Artificial Sequence: Synthetic polypeptide
  Variable HC Y059E
QVQLKQSGPGLVQPSQSLSITCTVSGFSLTNYGVHWVRQSPGKGLEWLGVIWSGGNTDENTPFTSRLSINKDNSKSQVFFKMNSLQSNDTAIYYCARALTYYDYEFAYWGQGTLVTVSA

SEQ ID NO: 11455 - protein, 119 aa, Artificial Sequence
  Description of Artificial Sequence: Synthetic polypeptide
  Variable HC Y059G
QVQLKQSGPGLVQPSQSLSITCTVSGFSLTNYGVHWVRQSPGKGLEWLGVIWSGGNTDGNTPFTSRLSINKDNSKSQVFFKMNSLQSNDTAIYYCARALTYYDYEFAYWGQGTLVTVSA

SEQ ID NO: 11456 - protein, 119 aa, Artificial Sequence
  Description of Artificial Sequence: Synthetic polypeptide
  Variable HC Y059I
QVQLKQSGPGLVQPSQSLSITCTVSGFSLTNYGVHWVRQSPGKGLEWLGVIWSGGNTDINTPFTSRLSINKDNSKSQVFFKMNSLQSNDTAIYYCARALTYYDYEFAYWGQGTLVTVSA

SEQ ID NO: 11457 - protein, 119 aa, Artificial Sequence
  Description of Artificial Sequence: Synthetic polypeptide
  Variable HC Y059P
QVQLKQSGPGLVQPSQSLSITCTVSGFSLTNYGVHWVRQSPGKGLEWLGVIWSGGNTDPNTPFTSRLSINKDNSKSQVFFKMNSLQSNDTAIYYCARALTYYDYEFAYWGQGTLVTVSA

SEQ ID NO: 11458 - protein, 119 aa, Artificial Sequence
  Description of Artificial Sequence: Synthetic polypeptide
  Variable HC Y059Q
QVQLKQSGPGLVQPSQSLSITCTVSGFSLTNYGVHWVRQSPGKGLEWLGVIWSGGNTDQNTPFTSRLSINKDNSKSQVFFKMNSLQSNDTAIYYCARALTYYDYEFAYWGQGTLVTVSA

SEQ ID NO: 11459 - protein, 119 aa, Artificial Sequence
  Description of Artificial Sequence: Synthetic polypeptide
  Variable HC Y059S
QVQLKQSGPGLVQPSQSLSITCTVSGFSLTNYGVHWVRQSPGKGLEWLGVIWSGGNTDSNTPFTSRLSINKDNSKSQVFFKMNSLQSNDTAIYYCARALTYYDYEFAYWGQGTLVTVSA

SEQ ID NO: 11460 - protein, 119 aa, Artificial Sequence
  Description of Artificial Sequence: Synthetic polypeptide
  Variable HC Y059T
QVQLKQSGPGLVQPSQSLSITCTVSGFSLTNYGVHWVRQSPGKGLEWLGVIWSGGNTDTNTPFTSRLSINKDNSKSQVFFKMNSLQSNDTAIYYCARALTYYDYEFAYWGQGTLVTVSA

SEQ ID NO: 11461 - protein, 119 aa, Artificial Sequence
  Description of Artificial Sequence: Synthetic polypeptide
  Variable HC Y059V
QVQLKQSGPGLVQPSQSLSITCTVSGFSLTNYGVHWVRQSPGKGLEWLGVIWSGGNTDVNTPFTSRLSINKDNSKSQVFFKMNSLQSNDTAIYYCARALTYYDYEFAYWGQGTLVTVSA

SEQ ID NO: 11462 - protein, 119 aa, Artificial Sequence
  Description of Artificial Sequence: Synthetic polypeptide
  Variable HC Y059W
QVQLKQSGPGLVQPSQSLSITCTVSGFSLTNYGVHWVRQSPGKGLEWLGVIWSGGNTDWNTPFTSRLSINKDNSKSQVFFKMNSLQSNDTAIYYCARALTYYDYEFAYWGQGTLVTVSA

SEQ ID NO: 11463 - protein, 119 aa, Artificial Sequence
  Description of Artificial Sequence: Synthetic polypeptide
  Variable HC N060K
QVQLKQSGPGLVQPSQSLSITCTVSGFSLTNYGVHWVRQSPGKGLEWLGVIWSGGNTDYKTPFTSRLSINKDNSKSQVFFKMNSLQSNDTAIYYCARALTYYDYEFAYWGQGTLVTVSA

SEQ ID NO: 11464 - protein, 119 aa, Artificial Sequence
  Description of Artificial Sequence: Synthetic polypeptide
  Variable HC N060A
QVQLKQSGPGLVQPSQSLSITCTVSGFSLTNYGVHWVRQSPGKGLEWLGVIWSGGNTDYATPFTSRLSINKDNSKSQVFFKMNSLQSNDTAIYYCARALTYYDYEFAYWGQGTLVTVSA

SEQ ID NO: 11465 - protein, 119 aa, Artificial Sequence
  Description of Artificial Sequence: Synthetic polypeptide
  Variable HC N060C
QVQLKQSGPGLVQPSQSLSITCTVSGFSLTNYGVHWVRQSPGKGLEWLGVIWSGGNTDYCTPFTSRLSINKDNSKSQVFFKMNSLQSNDTAIYYCARALTYYDYEFAYWGQGTLVTVSA

SEQ ID NO: 11466 - protein, 119 aa, Artificial Sequence
  Description of Artificial Sequence: Synthetic polypeptide
  Variable HC N060D
QVQLKQSGPGLVQPSQSLSITCTVSGFSLTNYGVHWVRQSPGKGLEWLGVIWSGGNTDYDTPFTSRLSINKDNSKSQVFFKMNSLQSNDTAIYYCARALTYYDYEFAYWGQGTLVTVSA

SEQ ID NO: 11467 - protein, 119 aa, Artificial Sequence
  Description of Artificial Sequence: Synthetic polypeptide
  Variable HC N060F
QVQLKQSGPGLVQPSQSLSITCTVSGFSLTNYGVHWVRQSPGKGLEWLGVIWSGGNTDYFTPFTSRLSINKDNSKSQVFFKMNSLQSNDTAIYYCARALTYYDYEFAYWGQGTLVTVSA

SEQ ID NO: 11468 - protein, 119 aa, Artificial Sequence
  Description of Artificial Sequence: Synthetic polypeptide
  Variable HC N060G
QVQLKQSGPGLVQPSQSLSITCTVSGFSLTNYGVHWVRQSPGKGLEWLGVIWSGGNTDYGTPFTSRLSINKDNSKSQVFFKMNSLQSNDTAIYYCARALTYYDYEFAYWGQGTLVTVSA

SEQ ID NO: 11469 - protein, 119 aa, Artificial Sequence
  Description of Artificial Sequence: Synthetic polypeptide
  Variable HC N060P
QVQLKQSGPGLVQPSQSLSITCTVSGFSLTNYGVHWVRQSPGKGLEWLGVIWSGGNTDYPTPFTSRLSINKDNSKSQVFFKMNSLQSNDTAIYYCARALTYYDYEFAYWGQGTLVTVSA

SEQ ID NO: 11470 - protein, 119 aa, Artificial Sequence
  Description of Artificial Sequence: Synthetic polypeptide
  Variable HC N060Q
QVQLKQSGPGLVQPSQSLSITCTVSGFSLTNYGVHWVRQSPGKGLEWLGVIWSGGNTDYQTPFTSRLSINKDNSKSQVFFKMNSLQSNDTAIYYCARALTYYDYEFAYWGQGTLVTVSA

SEQ ID NO: 11471 - protein, 119 aa, Artificial Sequence
  Description of Artificial Sequence: Synthetic polypeptide
  Variable HC N060S
QVQLKQSGPGLVQPSQSLSITCTVSGFSLTNYGVHWVRQSPGKGLEWLGVIWSGGNTDYSTPFTSRLSINKDNSKSQVFFKMNSLQSNDTAIYYCARALTYYDYEFAYWGQGTLVTVSA

SEQ ID NO: 11472 - protein, 119 aa, Artificial Sequence
  Description of Artificial Sequence: Synthetic polypeptide
  Variable HC N060T
QVQLKQSGPGLVQPSQSLSITCTVSGFSLTNYGVHWVRQSPGKGLEWLGVIWSGGNTDYTTPFTSRLSINKDNSKSQVFFKMNSLQSNDTAIYYCARALTYYDYEFAYWGQGTLVTVSA

SEQ ID NO: 11473 - protein, 119 aa, Artificial Sequence
  Description of Artificial Sequence: Synthetic polypeptide
  Variable HC N060Y
QVQLKQSGPGLVQPSQSLSITCTVSGFSLTNYGVHWVRQSPGKGLEWLGVIWSGGNTDYYTPFTSRLSINKDNSKSQVFFKMNSLQSNDTAIYYCARALTYYDYEFAYWGQGTLVTVSA

SEQ ID NO: 11474 - protein, 119 aa, Artificial Sequence
  Description of Artificial Sequence: Synthetic polypeptide
  Variable HC T061N
QVQLKQSGPGLVQPSQSLSITCTVSGFSLTNYGVHWVRQSPGKGLEWLGVIWSGGNTDYNNPFTSRLSINKDNSKSQVFFKMNSLQSNDTAIYYCARALTYYDYEFAYWGQGTLVTVSA

SEQ ID NO: 11475 - protein, 119 aa, Artificial Sequence
  Description of Artificial Sequence: Synthetic polypeptide
  Variable HC T061Q
QVQLKQSGPGLVQPSQSLSITCTVSGFSLTNYGVHWVRQSPGKGLEWLGVIWSGGNTDYNQPFTSRLSINKDNSKSQVFFKMNSLQSNDTAIYYCARALTYYDYEFAYWGQGTLVTVSA

SEQ ID NO: 11476 - protein, 119 aa, Artificial Sequence
  Description of Artificial Sequence: Synthetic polypeptide
  Variable HC P062G
QVQLKQSGPGLVQPSQSLSITCTVSGFSLTNYGVHWVRQSPGKGLEWLGVIWSGGNTDYNTGFTSRLSINKDNSKSQVFFKMNSLQSNDTAIYYCARALTYYDYEFAYWGQGTLVTVSA

SEQ ID NO: 11477 - protein, 119 aa, Artificial Sequence
  Description of Artificial Sequence: Synthetic polypeptide
  Variable HC F063H
QVQLKQSGPGLVQPSQSLSITCTVSGFSLTNYGVHWVRQSPGKGLEWLGVIWSGGNTDYNTPHTSRLSINKDNSKSQVFFKMNSLQSNDTAIYYCARALTYYDYEFAYWGQGTLVTVSA

SEQ ID NO: 11478 - protein, 119 aa, Artificial Sequence
  Description of Artificial Sequence: Synthetic polypeptide
  Variable HC F063R
QVQLKQSGPGLVQPSQSLSITCTVSGFSLTNYGVHWVRQSPGKGLEWLGVIWSGGNTDYNTPRTSRLSINKDNSKSQVFFKMNSLQSNDTAIYYCARALTYYDYEFAYWGQGTLVTVSA

SEQ ID NO: 11479 - protein, 119 aa, Artificial Sequence
  Description of Artificial Sequence: Synthetic polypeptide
  Variable HC F063L
QVQLKQSGPGLVQPSQSLSITCTVSGFSLTNYGVHWVRQSPGKGLEWLGVIWSGGNTDYNTPLTSRLSINKDNSKSQVFFKMNSLQSNDTAIYYCARALTYYDYEFAYWGQGTLVTVSA

SEQ ID NO: 11480 - protein, 119 aa, Artificial Sequence
  Description of Artificial Sequence: Synthetic polypeptide
  Variable HC F063A
QVQLKQSGPGLVQPSQSLSITCTVSGFSLTNYGVHWVRQSPGKGLEWLGVIWSGGNTDYNTPATSRLSINKDNSKSQVFFKMNSLQSNDTAIYYCARALTYYDYEFAYWGQGTLVTVSA

SEQ ID NO: 11481 - protein, 119 aa, Artificial Sequence
  Description of Artificial Sequence: Synthetic polypeptide
  Variable HC F063C
QVQLKQSGPGLVQPSQSLSITCTVSGFSLTNYGVHWVRQSPGKGLEWLGVIWSGGNTDYNTPCTSRLSINKDNSKSQVFFKMNSLQSNDTAIYYCARALTYYDYEFAYWGQGTLVTVSA

SEQ ID NO: 11482 - protein, 119 aa, Artificial Sequence
  Description of Artificial Sequence: Synthetic polypeptide
  Variable HC F063D
QVQLKQSGPGLVQPSQSLSITCTVSGFSLTNYGVHWVRQSPGKGLEWLGVIWSGGNTDYNTPDTSRLSINKDNSKSQVFFKMNSLQSNDTAIYYCARALTYYDYEFAYWGQGTLVTVSA

SEQ ID NO: 11483 - protein, 119 aa, Artificial Sequence
  Description of Artificial Sequence: Synthetic polypeptide
  Variable HC F063G
QVQLKQSGPGLVQPSQSLSITCTVSGFSLTNYGVHWVRQSPGKGLEWLGVIWSGGNTDYNTPGTSRLSINKDNSKSQVFFKMNSLQSNDTAIYYCARALTYYDYEFAYWGQGTLVTVSA

SEQ ID NO: 11484 - protein, 119 aa, Artificial Sequence
  Description of Artificial Sequence: Synthetic polypeptide
  Variable HC F063M
QVQLKQSGPGLVQPSQSLSITCTVSGFSLTNYGVHWVRQSPGKGLEWLGVIWSGGNTDYNTPMTSRLSINKDNSKSQVFFKMNSLQSNDTAIYYCARALTYYDYEFAYWGQGTLVTVSA

SEQ ID NO: 11485 - protein, 119 aa, Artificial Sequence
  Description of Artificial Sequence: Synthetic polypeptide
  Variable HC F063N
QVQLKQSGPGLVQPSQSLSITCTVSGFSLTNYGVHWVRQSPGKGLEWLGVIWSGGNTDYNTPNTSRLSINKDNSKSQVFFKMNSLQSNDTAIYYCARALTYYDYEFAYWGQGTLVTVSA

SEQ ID NO: 11486 - protein, 119 aa, Artificial Sequence
  Description of Artificial Sequence: Synthetic polypeptide
  Variable HC F063Q
QVQLKQSGPGLVQPSQSLSITCTVSGFSLTNYGVHWVRQSPGKGLEWLGVIWSGGNTDYNTPQTSRLSINKDNSKSQVFFKMNSLQSNDTAIYYCARALTYYDYEFAYWGQGTLVTVSA

SEQ ID NO: 11487 - protein, 119 aa, Artificial Sequence
  Description of Artificial Sequence: Synthetic polypeptide
  Variable HC F063S
QVQLKQSGPGLVQPSQSLSITCTVSGFSLTNYGVHWVRQSPGKGLEWLGVIWSGGNTDYNTPSTSRLSINKDNSKSQVFFKMNSLQSNDTAIYYCARALTYYDYEFAYWGQGTLVTVSA

SEQ ID NO: 11488 - protein, 119 aa, Artificial Sequence
  Description of Artificial Sequence: Synthetic polypeptide
  Variable HC F063V
QVQLKQSGPGLVQPSQSLSITCTVSGFSLTNYGVHWVRQSPGKGLEWLGVIWSGGNTDYNTPVTSRLSINKDNSKSQVFFKMNSLQSNDTAIYYCARALTYYDYEFAYWGQGTLVTVSA

SEQ ID NO: 11489 - protein, 119 aa, Artificial Sequence
  Description of Artificial Sequence: Synthetic polypeptide
  Variable HC T064R
QVQLKQSGPGLVQPSQSLSITCTVSGFSLTNYGVHWVRQSPGKGLEWLGVIWSGGNTDYNTPFRSRLSINKDNSKSQVFFKMNSLQSNDTAIYYCARALTYYDYEFAYWGQGTLVTVSA

SEQ ID NO: 11490 - protein, 119 aa, Artificial Sequence
  Description of Artificial Sequence: Synthetic polypeptide
  Variable HC T064L
QVQLKQSGPGLVQPSQSLSITCTVSGFSLTNYGVHWVRQSPGKGLEWLGVIWSGGNTDYNTPFLSRLSINKDNSKSQVFFKMNSLQSNDTAIYYCARALTYYDYEFAYWGQGTLVTVSA

SEQ ID NO: 11491 - protein, 119 aa, Artificial Sequence
  Description of Artificial Sequence: Synthetic polypeptide
  Variable HC T064C
QVQLKQSGPGLVQPSQSLSITCTVSGFSLTNYGVHWVRQSPGKGLEWLGVIWSGGNTDYNTPFCSRLSINKDNSKSQVFFKMNSLQSNDTAIYYCARALTYYDYEFAYWGQGTLVTVSA

SEQ ID NO: 11492 - protein, 119 aa, Artificial Sequence
  Description of Artificial Sequence: Synthetic polypeptide
  Variable HC T064F
QVQLKQSGPGLVQPSQSLSITCTVSGFSLTNYGVHWVRQSPGKGLEWLGVIWSGGNTDYNTPFFSRLSINKDNSKSQVFFKMNSLQSNDTAIYYCARALTYYDYEFAYWGQGTLVTVSA

SEQ ID NO: 11493 - protein, 119 aa, Artificial Sequence
  Description of Artificial Sequence: Synthetic polypeptide
  Variable HC T064G
QVQLKQSGPGLVQPSQSLSITCTVSGFSLTNYGVHWVRQSPGKGLEWLGVIWSGGNTDYNTPFGSRLSINKDNSKSQVFFKMNSLQSNDTAIYYCARALTYYDYEFAYWGQGTLVTVSA

SEQ ID NO: 11494 - protein, 119 aa, Artificial Sequence
  Description of Artificial Sequence: Synthetic polypeptide
  Variable HC T064N
QVQLKQSGPGLVQPSQSLSITCTVSGFSLTNYGVHWVRQSPGKGLEWLGVIWSGGNTDYNTPFNSRLSINKDNSKSQVFFKMNSLQSNDTAIYYCARALTYYDYEFAYWGQGTLVTVSA

SEQ ID NO: 11495 - protein, 119 aa, Artificial Sequence
  Description of Artificial Sequence: Synthetic polypeptide
  Variable HC T064Q
QVQLKQSGPGLVQPSQSLSITCTVSGFSLTNYGVHWVRQSPGKGLEWLGVIWSGGNTDYNTPFQSRLSINKDNSKSQVFFKMNSLQSNDTAIYYCARALTYYDYEFAYWGQGTLVTVSA

SEQ ID NO: 11496 - protein, 119 aa, Artificial Sequence
  Description of Artificial Sequence: Synthetic polypeptide
  Variable HC T064V
QVQLKQSGPGLVQPSQSLSITCTVSGFSLTNYGVHWVRQSPGKGLEWLGVIWSGGNTDYNTPFVSRLSINKDNSKSQVFFKMNSLQSNDTAIYYCARALTYYDYEFAYWGQGTLVTVSA

SEQ ID NO: 11497 - protein, 119 aa, Artificial Sequence
  Description of Artificial Sequence: Synthetic polypeptide
  Variable HC S065H
QVQLKQSGPGLVQPSQSLSITCTVSGFSLTNYGVHWVRQSPGKGLEWLGVIWSGGNTDYNTPFTHRLSINKDNSKSQVFFKMNSLQSNDTAIYYCARALTYYDYEFAYWGQGTLVTVSA

SEQ ID NO: 11498 - protein, 119 aa, Artificial Sequence
  Description of Artificial Sequence: Synthetic polypeptide
  Variable HC S065R
QVQLKQSGPGLVQPSQSLSITCTVSGFSLTNYGVHWVRQSPGKGLEWLGVIWSGGNTDYNTPFTRRLSINKDNSKSQVFFKMNSLQSNDTAIYYCARALTYYDYEFAYWGQGTLVTVSA

SEQ ID NO: 11499 - protein, 119 aa, Artificial Sequence
  Description of Artificial Sequence: Synthetic polypeptide
  Variable HC S065L
QVQLKQSGPGLVQPSQSLSITCTVSGFSLTNYGVHWVRQSPGKGLEWLGVIWSGGNTDYNTPFTLRLSINKDNSKSQVFFKMNSLQSNDTAIYYCARALTYYDYEFAYWGQGTLVTVSA

SEQ ID NO: 11500 - protein, 119 aa, Artificial Sequence
  Description of Artificial Sequence: Synthetic polypeptide
  Variable HC S065C
QVQLKQSGPGLVQPSQSLSITCTVSGFSLTNYGVHWVRQSPGKGLEWLGVIWSGGNTDYNTPFTCRLSINKDNSKSQVFFKMNSLQSNDTAIYYCARALTYYDYEFAYWGQGTLVTVSA

SEQ ID NO: 11501 - protein, 119 aa, Artificial Sequence
  Description of Artificial Sequence: Synthetic polypeptide
  Variable HC S065E
QVQLKQSGPGLVQPSQSLSITCTVSGFSLTNYGVHWVRQSPGKGLEWLGVIWSGGNTDYNTPFTERLSINKDNSKSQVFFKMNSLQSNDTAIYYCARALTYYDYEFAYWGQGTLVTVSA

SEQ ID NO: 11502 - protein, 119 aa, Artificial Sequence
  Description of Artificial Sequence: Synthetic polypeptide
  Variable HC S065F
QVQLKQSGPGLVQPSQSLSITCTVSGFSLTNYGVHWVRQSPGKGLEWLGVIWSGGNTDYNTPFTFRLSINKDNSKSQVFFKMNSLQSNDTAIYYCARALTYYDYEFAYWGQGTLVTVSA

SEQ ID NO: 11503 - protein, 119 aa, Artificial Sequence
  Description of Artificial Sequence: Synthetic polypeptide
  Variable HC S065G
QVQLKQSGPGLVQPSQSLSITCTVSGFSLTNYGVHWVRQSPGKGLEWLGVIWSGGNTDYNTPFTGRLSINKDNSKSQVFFKMNSLQSNDTAIYYCARALTYYDYEFAYWGQGTLVTVSA

SEQ ID NO: 11504 - protein, 119 aa, Artificial Sequence
  Description of Artificial Sequence: Synthetic polypeptide
  Variable HC S065I
QVQLKQSGPGLVQPSQSLSITCTVSGFSLTNYGVHWVRQSPGKGLEWLGVIWSGGNTDYNTPFTIRLSINKDNSKSQVFFKMNSLQSNDTAIYYCARALTYYDYEFAYWGQGTLVTVSA

SEQ ID NO: 11505 - protein, 119 aa, Artificial Sequence
  Description of Artificial Sequence: Synthetic polypeptide
  Variable HC S065M
QVQLKQSGPGLVQPSQSLSITCTVSGFSLTNYGVHWVRQSPGKGLEWLGVIWSGGNTDYNTPFTMRLSINKDNSKSQVFFKMNSLQSNDTAIYYCARALTYYDYEFAYWGQGTLVTVSA

SEQ ID NO: 11506 - protein, 119 aa, Artificial Sequence
  Description of Artificial Sequence: Synthetic polypeptide
  Variable HC S065N
QVQLKQSGPGLVQPSQSLSITCTVSGFSLTNYGVHWVRQSPGKGLEWLGVIWSGGNTDYNTPFTNRLSINKDNSKSQVFFKMNSLQSNDTAIYYCARALTYYDYEFAYWGQGTLVTVSA

SEQ ID NO: 11507 - protein, 119 aa, Artificial Sequence
  Description of Artificial Sequence: Synthetic polypeptide
  Variable HC S065P
QVQLKQSGPGLVQPSQSLSITCTVSGFSLTNYGVHWVRQSPGKGLEWLGVIWSGGNTDYNTPFTPRLSINKDNSKSQVFFKMNSLQSNDTAIYYCARALTYYDYEFAYWGQGTLVTVSA

SEQ ID NO: 11508 - protein, 119 aa, Artificial Sequence
  Description of Artificial Sequence: Synthetic polypeptide
  Variable HC S065Q
QVQLKQSGPGLVQPSQSLSITCTVSGFSLTNYGVHWVRQSPGKGLEWLGVIWSGGNTDYNTPFTQRLSINKDNSKSQVFFKMNSLQSNDTAIYYCARALTYYDYEFAYWGQGTLVTVSA

SEQ ID NO: 11509 - protein, 119 aa, Artificial Sequence
  Description of Artificial Sequence: Synthetic polypeptide
  Variable HC S065T
QVQLKQSGPGLVQPSQSLSITCTVSGFSLTNYGVHWVRQSPGKGLEWLGVIWSGGNTDYNTPFTTRLSINKDNSKSQVFFKMNSLQSNDTAIYYCARALTYYDYEFAYWGQGTLVTVSA

SEQ ID NO: 11510 - protein, 119 aa, Artificial Sequence
  Description of Artificial Sequence: Synthetic polypeptide
  Variable HC S065W
QVQLKQSGPGLVQPSQSLSITCTVSGFSLTNYGVHWVRQSPGKGLEWLGVIWSGGNTDYNTPFTWRLSINKDNSKSQVFFKMNSLQSNDTAIYYCARALTYYDYEFAYWGQGTLVTVSA

SEQ ID NO: 11511 - protein, 119 aa, Artificial Sequence
  Description of Artificial Sequence: Synthetic polypeptide
  Variable HC S065Y
QVQLKQSGPGLVQPSQSLSITCTVSGFSLTNYGVHWVRQSPGKGLEWLGVIWSGGNTDYNTPFTYRLSINKDNSKSQVFFKMNSLQSNDTAIYYCARALTYYDYEFAYWGQGTLVTVSA

SEQ ID NO: 11512 - protein, 119 aa, Artificial Sequence
  Description of Artificial Sequence: Synthetic polypeptide
  Variable HC R066L
QVQLKQSGPGLVQPSQSLSITCTVSGFSLTNYGVHWVRQSPGKGLEWLGVIWSGGNTDYNTPFTSLLSINKDNSKSQVFFKMNSLQSNDTAIYYCARALTYYDYEFAYWGQGTLVTVSA

SEQ ID NO: 11513 - protein, 119 aa, Artificial Sequence
  Description of Artificial Sequence: Synthetic polypeptide
  Variable HC R066A
QVQLKQSGPGLVQPSQSLSITCTVSGFSLTNYGVHWVRQSPGKGLEWLGVIWSGGNTDYNTPFTSALSINKDNSKSQVFFKMNSLQSNDTAIYYCARALTYYDYEFAYWGQGTLVTVSA

SEQ ID NO: 11514 - protein, 119 aa, Artificial Sequence
  Description of Artificial Sequence: Synthetic polypeptide
  Variable HC R066C
QVQLKQSGPGLVQPSQSLSITCTVSGFSLTNYGVHWVRQSPGKGLEWLGVIWSGGNTDYNTPFTSCLSINKDNSKSQVFFKMNSLQSNDTAIYYCARALTYYDYEFAYWGQGTLVTVSA

SEQ ID NO: 11515 - protein, 119 aa, Artificial Sequence
  Description of Artificial Sequence: Synthetic polypeptide
  Variable HC R066E
QVQLKQSGPGLVQPSQSLSITCTVSGFSLTNYGVHWVRQSPGKGLEWLGVIWSGGNTDYNTPFTSELSINKDNSKSQVFFKMNSLQSNDTAIYYCARALTYYDYEFAYWGQGTLVTVSA

SEQ ID NO: 11516 - protein, 119 aa, Artificial Sequence
  Description of Artificial Sequence: Synthetic polypeptide
  Variable HC R066F
QVQLKQSGPGLVQPSQSLSITCTVSGFSLTNYGVHWVRQSPGKGLEWLGVIWSGGNTDYNTPFTSFLSINKDNSKSQVFFKMNSLQSNDTAIYYCARALTYYDYEFAYWGQGTLVTVSA

SEQ ID NO: 11517 - protein, 119 aa, Artificial Sequence
  Description of Artificial Sequence: Synthetic polypeptide
  Variable HC R066N
QVQLKQSGPGLVQPSQSLSITCTVSGFSLTNYGVHWVRQSPGKGLEWLGVIWSGGNTDYNTPFTSNLSINKDNSKSQVFFKMNSLQSNDTAIYYCARALTYYDYEFAYWGQGTLVTVSA

SEQ ID NO: 11518 - protein, 119 aa, Artificial Sequence
  Description of Artificial Sequence: Synthetic polypeptide
  Variable HC R066P
QVQLKQSGPGLVQPSQSLSITCTVSGFSLTNYGVHWVRQSPGKGLEWLGVIWSGGNTDYNTPFTSPLSINKDNSKSQVFFKMNSLQSNDTAIYYCARALTYYDYEFAYWGQGTLVTVSA

SEQ ID NO: 11519 - protein, 119 aa, Artificial Sequence
  Description of Artificial Sequence: Synthetic polypeptide
  Variable HC R066Q
QVQLKQSGPGLVQPSQSLSITCTVSGFSLTNYGVHWVRQSPGKGLEWLGVIWSGGNTDYNTPFTSQLSINKDNSKSQVFFKMNSLQSNDTAIYYCARALTYYDYEFAYWGQGTLVTVSA

SEQ ID NO: 11520 - protein, 119 aa, Artificial Sequence
  Description of Artificial Sequence: Synthetic polypeptide
  Variable HC R066S
QVQLKQSGPGLVQPSQSLSITCTVSGFSLTNYGVHWVRQSPGKGLEWLGVIWSGGNTDYNTPFTSSLSINKDNSKSQVFFKMNSLQSNDTAIYYCARALTYYDYEFAYWGQGTLVTVSA

SEQ ID NO: 11521 - protein, 119 aa, Artificial Sequence
  Description of Artificial Sequence: Synthetic polypeptide
  Variable HC R066T
QVQLKQSGPGLVQPSQSLSITCTVSGFSLTNYGVHWVRQSPGKGLEWLGVIWSGGNTDYNTPFTSTLSINKDNSKSQVFFKMNSLQSNDTAIYYCARALTYYDYEFAYWGQGTLVTVSA

SEQ ID NO: 11522 - protein, 119 aa, Artificial Sequence
  Description of Artificial Sequence: Synthetic polypeptide
  Variable HC R066V
QVQLKQSGPGLVQPSQSLSITCTVSGFSLTNYGVHWVRQSPGKGLEWLGVIWSGGNTDYNTPFTSVLSINKDNSKSQVFFKMNSLQSNDTAIYYCARALTYYDYEFAYWGQGTLVTVSA

SEQ ID NO: 11523 - protein, 119 aa, Artificial Sequence
  Description of Artificial Sequence: Synthetic polypeptide
  Variable HC R066G
QVQLKQSGPGLVQPSQSLSITCTVSGFSLTNYGVHWVRQSPGKGLEWLGVIWSGGNTDYNTPFTSGLSINKDNSKSQVFFKMNSLQSNDTAIYYCARALTYYDYEFAYWGQGTLVTVSA

SEQ ID NO: 11524 - protein, 119 aa, Artificial Sequence
  Description of Artificial Sequence: Synthetic polypeptide
  Variable HC L067A
QVQLKQSGPGLVQPSQSLSITCTVSGFSLTNYGVHWVRQSPGKGLEWLGVIWSGGNTDYNTPFTSRASINKDNSKSQVFFKMNSLQSNDTAIYYCARALTYYDYEFAYWGQGTLVTVSA

SEQ ID NO: 11525 - protein, 119 aa, Artificial Sequence
  Description of Artificial Sequence: Synthetic polypeptide
  Variable HC L067C
QVQLKQSGPGLVQPSQSLSITCTVSGFSLTNYGVHWVRQSPGKGLEWLGVIWSGGNTDYNTPFTSRCSINKDNSKSQVFFKMNSLQSNDTAIYYCARALTYYDYEFAYWGQGTLVTVSA

SEQ ID NO: 11526 - protein, 119 aa, Artificial Sequence
  Description of Artificial Sequence: Synthetic polypeptide
  Variable HC L067D
QVQLKQSGPGLVQPSQSLSITCTVSGFSLTNYGVHWVRQSPGKGLEWLGVIWSGGNTDYNTPFTSRDSINKDNSKSQVFFKMNSLQSNDTAIYYCARALTYYDYEFAYWGQGTLVTVSA

SEQ ID NO: 11527 - protein, 119 aa, Artificial Sequence
  Description of Artificial Sequence: Synthetic polypeptide
  Variable HC L067E
QVQLKQSGPGLVQPSQSLSITCTVSGFSLTNYGVHWVRQSPGKGLEWLGVIWSGGNTDYNTPFTSRESINKDNSKSQVFFKMNSLQSNDTAIYYCARALTYYDYEFAYWGQGTLVTVSA

SEQ ID NO: 11528 - protein, 119 aa, Artificial Sequence
  Description of Artificial Sequence: Synthetic polypeptide
  Variable HC L067I
QVQLKQSGPGLVQPSQSLSITCTVSGFSLTNYGVHWVRQSPGKGLEWLGVIWSGGNTDYNTPFTSRISINKDNSKSQVFFKMNSLQSNDTAIYYCARALTYYDYEFAYWGQGTLVTVSA

SEQ ID NO: 11529 - protein, 119 aa, Artificial Sequence
  Description of Artificial Sequence: Synthetic polypeptide
  Variable HC L067M
QVQLKQSGPGLVQPSQSLSITCTVSGFSLTNYGVHWVRQSPGKGLEWLGVIWSGGNTDYNTPFTSRMSINKDNSKSQVFFKMNSLQSNDTAIYYCARALTYYDYEFAYWGQGTLVTVSA

SEQ ID NO: 11530 - protein, 119 aa, Artificial Sequence
  Description of Artificial Sequence: Synthetic polypeptide
  Variable HC L067Q
QVQLKQSGPGLVQPSQSLSITCTVSGFSLTNYGVHWVRQSPGKGLEWLGVIWSGGNTDYNTPFTSRQSINKDNSKSQVFFKMNSLQSNDTAIYYCARALTYYDYEFAYWGQGTLVTVSA

SEQ ID NO: 11531 - protein, 119 aa, Artificial Sequence
  Description of Artificial Sequence: Synthetic polypeptide
  Variable HC L067S
QVQLKQSGPGLVQPSQSLSITCTVSGFSLTNYGVHWVRQSPGKGLEWLGVIWSGGNTDYNTPFTSRSSINKDNSKSQVFFKMNSLQSNDTAIYYCARALTYYDYEFAYWGQGTLVTVSA

SEQ ID NO: 11532 - protein, 119 aa, Artificial Sequence
  Description of Artificial Sequence: Synthetic polypeptide
  Variable HC L067T
QVQLKQSGPGLVQPSQSLSITCTVSGFSLTNYGVHWVRQSPGKGLEWLGVIWSGGNTDYNTPFTSRTSINKDNSKSQVFFKMNSLQSNDTAIYYCARALTYYDYEFAYWGQGTLVTVSA

SEQ ID NO: 11533 - protein, 119 aa, Artificial Sequence
  Description of Artificial Sequence: Synthetic polypeptide
  Variable HC L067V
QVQLKQSGPGLVQPSQSLSITCTVSGFSLTNYGVHWVRQSPGKGLEWLGVIWSGGNTDYNTPFTSRVSINKDNSKSQVFFKMNSLQSNDTAIYYCARALTYYDYEFAYWGQGTLVTVSA

SEQ ID NO: 11534 - protein, 119 aa, Artificial Sequence
  Description of Artificial Sequence: Synthetic polypeptide
  Variable HC L067Y
QVQLKQSGPGLVQPSQSLSITCTVSGFSLTNYGVHWVRQSPGKGLEWLGVIWSGGNTDYNTPFTSRYSINKDNSKSQVFFKMNSLQSNDTAIYYCARALTYYDYEFAYWGQGTLVTVSA

SEQ ID NO: 11535 - protein, 119 aa, Artificial Sequence
  Description of Artificial Sequence: Synthetic polypeptide
  Variable HC S068K
QVQLKQSGPGLVQPSQSLSITCTVSGFSLTNYGVHWVRQSPGKGLEWLGVIWSGGNTDYNTPFTSRLKINKDNSKSQVFFKMNSLQSNDTAIYYCARALTYYDYEFAYWGQGTLVTVSA

SEQ ID NO: 11536 - protein, 119 aa, Artificial Sequence
  Description of Artificial Sequence: Synthetic polypeptide
  Variable HC S068H
QVQLKQSGPGLVQPSQSLSITCTVSGFSLTNYGVHWVRQSPGKGLEWLGVIWSGGNTDYNTPFTSRLHINKDNSKSQVFFKMNSLQSNDTAIYYCARALTYYDYEFAYWGQGTLVTVSA

SEQ ID NO: 11537 - protein, 119 aa, Artificial Sequence
  Description of Artificial Sequence: Synthetic polypeptide
  Variable HC S068R
QVQLKQSGPGLVQPSQSLSITCTVSGFSLTNYGVHWVRQSPGKGLEWLGVIWSGGNTDYNTPFTSRLRINKDNSKSQVFFKMNSLQSNDTAIYYCARALTYYDYEFAYWGQGTLVTVSA

SEQ ID NO: 11538 - protein, 119 aa, Artificial Sequence
  Description of Artificial Sequence: Synthetic polypeptide
  Variable HC S068L
QVQLKQSGPGLVQPSQSLSITCTVSGFSLTNYGVHWVRQSPGKGLEWLGVIWSGGNTDYNTPFTSRLLINKDNSKSQVFFKMNSLQSNDTAIYYCARALTYYDYEFAYWGQGTLVTVSA

SEQ ID NO: 11539 - protein, 119 aa, Artificial Sequence
  Description of Artificial Sequence: Synthetic polypeptide
  Variable HC S068C
QVQLKQSGPGLVQPSQSLSITCTVSGFSLTNYGVHWVRQSPGKGLEWLGVIWSGGNTDYNTPFTSRLCINKDNSKSQVFFKMNSLQSNDTAIYYCARALTYYDYEFAYWGQGTLVTVSA

SEQ ID NO: 11540 - protein, 119 aa, Artificial Sequence
  Description of Artificial Sequence: Synthetic polypeptide
  Variable HC S068D
QVQLKQSGPGLVQPSQSLSITCTVSGFSLTNYGVHWVRQSPGKGLEWLGVIWSGGNTDYNTPFTSRLDINKDNSKSQVFFKMNSLQSNDTAIYYCARALTYYDYEFAYWGQGTLVTVSA

SEQ ID NO: 11541 - protein, 119 aa, Artificial Sequence
  Description of Artificial Sequence: Synthetic polypeptide
  Variable HC S068E
QVQLKQSGPGLVQPSQSLSITCTVSGFSLTNYGVHWVRQSPGKGLEWLGVIWSGGNTDYNTPFTSRLEINKDNSKSQVFFKMNSLQSNDTAIYYCARALTYYDYEFAYWGQGTLVTVSA

SEQ ID NO: 11542 - protein, 119 aa, Artificial Sequence
  Description of Artificial Sequence: Synthetic polypeptide
  Variable HC S068F
QVQLKQSGPGLVQPSQSLSITCTVSGFSLTNYGVHWVRQSPGKGLEWLGVIWSGGNTDYNTPFTSRLFINKDNSKSQVFFKMNSLQSNDTAIYYCARALTYYDYEFAYWGQGTLVTVSA

SEQ ID NO: 11543 - protein, 119 aa, Artificial Sequence
  Description of Artificial Sequence: Synthetic polypeptide
  Variable HC S068G
QVQLKQSGPGLVQPSQSLSITCTVSGFSLTNYGVHWVRQSPGKGLEWLGVIWSGGNTDYNTPFTSRLGINKDNSKSQVFFKMNSLQSNDTAIYYCARALTYYDYEFAYWGQGTLVTVSA

SEQ ID NO: 11544 - protein, 119 aa, Artificial Sequence
  Description of Artificial Sequence: Synthetic polypeptide
  Variable HC S068I
QVQLKQSGPGLVQPSQSLSITCTVSGFSLTNYGVHWVRQSPGKGLEWLGVIWSGGNTDYNTPFTSRLIINKDNSKSQVFFKMNSLQSNDTAIYYCARALTYYDYEFAYWGQGTLVTVSA

SEQ ID NO: 11545 - protein, 119 aa, Artificial Sequence
  Description of Artificial Sequence: Synthetic polypeptide
  Variable HC S068N
QVQLKQSGPGLVQPSQSLSITCTVSGFSLTNYGVHWVRQSPGKGLEWLGVIWSGGNTDYNTPFTSRLNINKDNSKSQVFFKMNSLQSNDTAIYYCARALTYYDYEFAYWGQGTLVTVSA

SEQ ID NO: 11546 - protein, 119 aa, Artificial Sequence
  Description of Artificial Sequence: Synthetic polypeptide
  Variable HC S068Q
QVQLKQSGPGLVQPSQSLSITCTVSGFSLTNYGVHWVRQSPGKGLEWLGVIWSGGNTDYNTPFTSRLQINKDNSKSQVFFKMNSLQSNDTAIYYCARALTYYDYEFAYWGQGTLVTVSA

SEQ ID NO: 11547 - protein, 119 aa, Artificial Sequence
  Description of Artificial Sequence: Synthetic polypeptide
  Variable HC S068T
QVQLKQSGPGLVQPSQSLSITCTVSGFSLTNYGVHWVRQSPGKGLEWLGVIWSGGNTDYNTPFTSRLTINKDNSKSQVFFKMNSLQSNDTAIYYCARALTYYDYEFAYWGQGTLVTVSA

SEQ ID NO: 11548 - protein, 119 aa, Artificial Sequence
  Description of Artificial Sequence: Synthetic polypeptide
  Variable HC S068V
QVQLKQSGPGLVQPSQSLSITCTVSGFSLTNYGVHWVRQSPGKGLEWLGVIWSGGNTDYNTPFTSRLVINKDNSKSQVFFKMNSLQSNDTAIYYCARALTYYDYEFAYWGQGTLVTVSA

SEQ ID NO: 11549 - protein, 119 aa, Artificial Sequence
  Description of Artificial Sequence: Synthetic polypeptide
  Variable HC I069A
QVQLKQSGPGLVQPSQSLSITCTVSGFSLTNYGVHWVRQSPGKGLEWLGVIWSGGNTDYNTPFTSRLSANKDNSKSQVFFKMNSLQSNDTAIYYCARALTYYDYEFAYWGQGTLVTVSA

SEQ ID NO: 11550 - protein, 119 aa, Artificial Sequence
  Description of Artificial Sequence: Synthetic polypeptide
  Variable HC I069C
QVQLKQSGPGLVQPSQSLSITCTVSGFSLTNYGVHWVRQSPGKGLEWLGVIWSGGNTDYNTPFTSRLSCNKDNSKSQVFFKMNSLQSNDTAIYYCARALTYYDYEFAYWGQGTLVTVSA

SEQ ID NO: 11551 - protein, 119 aa, Artificial Sequence
  Description of Artificial Sequence: Synthetic polypeptide
  Variable HC I069G
QVQLKQSGPGLVQPSQSLSITCTVSGFSLTNYGVHWVRQSPGKGLEWLGVIWSGGNTDYNTPFTSRLSGNKDNSKSQVFFKMNSLQSNDTAIYYCARALTYYDYEFAYWGQGTLVTVSA

SEQ ID NO: 11552 - protein, 119 aa, Artificial Sequence
  Description of Artificial Sequence: Synthetic polypeptide
  Variable HC I069Y
QVQLKQSGPGLVQPSQSLSITCTVSGFSLTNYGVHWVRQSPGKGLEWLGVIWSGGNTDYNTPFTSRLSYNKDNSKSQVFFKMNSLQSNDTAIYYCARALTYYDYEFAYWGQGTLVTVSA

SEQ ID NO: 11553 - protein, 119 aa, Artificial Sequence
  Description of Artificial Sequence: Synthetic polypeptide
  Variable HC N070H
QVQLKQSGPGLVQPSQSLSITCTVSGFSLTNYGVHWVRQSPGKGLEWLGVIWSGGNTDYNTPFTSRLSIHKDNSKSQVFFKMNSLQSNDTAIYYCARALTYYDYEFAYWGQGTLVTVSA

SEQ ID NO: 11554 - protein, 119 aa, Artificial Sequence
  Description of Artificial Sequence: Synthetic polypeptide
  Variable HC N070R
QVQLKQSGPGLVQPSQSLSITCTVSGFSLTNYGVHWVRQSPGKGLEWLGVIWSGGNTDYNTPFTSRLSIRKDNSKSQVFFKMNSLQSNDTAIYYCARALTYYDYEFAYWGQGTLVTVSA

SEQ ID NO: 11555 - protein, 119 aa, Artificial Sequence
  Description of Artificial Sequence: Synthetic polypeptide
  Variable HC N070L
QVQLKQSGPGLVQPSQSLSITCTVSGFSLTNYGVHWVRQSPGKGLEWLGVIWSGGNTDYNTPFTSRLSILKDNSKSQVFFKMNSLQSNDTAIYYCARALTYYDYEFAYWGQGTLVTVSA

SEQ ID NO: 11556 - protein, 119 aa, Artificial Sequence
  Description of Artificial Sequence: Synthetic polypeptide
  Variable HC N070D
QVQLKQSGPGLVQPSQSLSITCTVSGFSLTNYGVHWVRQSPGKGLEWLGVIWSGGNTDYNTPFTSRLSIDKDNSKSQVFFKMNSLQSNDTAIYYCARALTYYDYEFAYWGQGTLVTVSA

SEQ ID NO: 11557 - protein, 119 aa, Artificial Sequence
  Description of Artificial Sequence: Synthetic polypeptide
  Variable HC N070E
QVQLKQSGPGLVQPSQSLSITCTVSGFSLTNYGVHWVRQSPGKGLEWLGVIWSGGNTDYNTPFTSRLSIEKDNSKSQVFFKMNSLQSNDTAIYYCARALTYYDYEFAYWGQGTLVTVSA

SEQ ID NO: 11558 - protein, 119 aa, Artificial Sequence
  Description of Artificial Sequence: Synthetic polypeptide
  Variable HC N070F
QVQLKQSGPGLVQPSQSLSITCTVSGFSLTNYGVHWVRQSPGKGLEWLGVIWSGGNTDYNTPFTSRLSIFKDNSKSQVFFKMNSLQSNDTAIYYCARALTYYDYEFAYWGQGTLVTVSA

SEQ ID NO: 11559 - protein, 119 aa, Artificial Sequence
  Description of Artificial Sequence: Synthetic polypeptide
  Variable HC N070G
QVQLKQSGPGLVQPSQSLSITCTVSGFSLTNYGVHWVRQSPGKGLEWLGVIWSGGNTDYNTPFTSRLSIGKDNSKSQVFFKMNSLQSNDTAIYYCARALTYYDYEFAYWGQGTLVTVSA

SEQ ID NO: 11560 - protein, 119 aa, Artificial Sequence
  Description of Artificial Sequence: Synthetic polypeptide
  Variable HC N070I
QVQLKQSGPGLVQPSQSLSITCTVSGFSLTNYGVHWVRQSPGKGLEWLGVIWSGGNTDYNTPFTSRLSIIKDNSKSQVFFKMNSLQSNDTAIYYCARALTYYDYEFAYWGQGTLVTVSA

SEQ ID NO: 11561 - protein, 119 aa, Artificial Sequence
  Description of Artificial Sequence: Synthetic polypeptide
  Variable HC N070P
QVQLKQSGPGLVQPSQSLSITCTVSGFSLTNYGVHWVRQSPGKGLEWLGVIWSGGNTDYNTPFTSRLSIPKDNSKSQVFFKMNSLQSNDTAIYYCARALTYYDYEFAYWGQGTLVTVSA

SEQ ID NO: 11562 - protein, 119 aa, Artificial Sequence
  Description of Artificial Sequence: Synthetic polypeptide
  Variable HC N070Q
QVQLKQSGPGLVQPSQSLSITCTVSGFSLTNYGVHWVRQSPGKGLEWLGVIWSGGNTDYNTPFTSRLSIQKDNSKSQVFFKMNSLQSNDTAIYYCARALTYYDYEFAYWGQGTLVTVSA

SEQ ID NO: 11563 - protein, 119 aa, Artificial Sequence
  Description of Artificial Sequence: Synthetic polypeptide
  Variable HC N070S
QVQLKQSGPGLVQPSQSLSITCTVSGFSLTNYGVHWVRQSPGKGLEWLGVIWSGGNTDYNTPFTSRLSISKDNSKSQVFFKMNSLQSNDTAIYYCARALTYYDYEFAYWGQGTLVTVSA

SEQ ID NO: 11564 - protein, 119 aa, Artificial Sequence
  Description of Artificial Sequence: Synthetic polypeptide
  Variable HC N070T
QVQLKQSGPGLVQPSQSLSITCTVSGFSLTNYGVHWVRQSPGKGLEWLGVIWSGGNTDYNTPFTSRLSITKDNSKSQVFFKMNSLQSNDTAIYYCARALTYYDYEFAYWGQGTLVTVSA

SEQ ID NO: 11565 - protein, 119 aa, Artificial Sequence
  Description of Artificial Sequence: Synthetic polypeptide
  Variable HC N070V
QVQLKQSGPGLVQPSQSLSITCTVSGFSLTNYGVHWVRQSPGKGLEWLGVIWSGGNTDYNTPFTSRLSIVKDNSKSQVFFKMNSLQSNDTAIYYCARALTYYDYEFAYWGQGTLVTVSA

SEQ ID NO: 11566 - protein, 119 aa, Artificial Sequence
  Description of Artificial Sequence: Synthetic polypeptide
  Variable HC N070Y
QVQLKQSGPGLVQPSQSLSITCTVSGFSLTNYGVHWVRQSPGKGLEWLGVIWSGGNTDYNTPFTSRLSIYKDNSKSQVFFKMNSLQSNDTAIYYCARALTYYDYEFAYWGQGTLVTVSA

SEQ ID NO: 11567 - protein, 119 aa, Artificial Sequence
  Description of Artificial Sequence: Synthetic polypeptide
  Variable HC K071H
QVQLKQSGPGLVQPSQSLSITCTVSGFSLTNYGVHWVRQSPGKGLEWLGVIWSGGNTDYNTPFTSRLSINHDNSKSQVFFKMNSLQSNDTAIYYCARALTYYDYEFAYWGQGTLVTVSA

SEQ ID NO: 11568 - protein, 119 aa, Artificial Sequence
  Description of Artificial Sequence: Synthetic polypeptide
  Variable HC K071R
QVQLKQSGPGLVQPSQSLSITCTVSGFSLTNYGVHWVRQSPGKGLEWLGVIWSGGNTDYNTPFTSRLSINRDNSKSQVFFKMNSLQSNDTAIYYCARALTYYDYEFAYWGQGTLVTVSA

SEQ ID NO: 11569 - protein, 119 aa, Artificial Sequence
  Description of Artificial Sequence: Synthetic polypeptide
  Variable HC K071L
QVQLKQSGPGLVQPSQSLSITCTVSGFSLTNYGVHWVRQSPGKGLEWLGVIWSGGNTDYNTPFTSRLSINLDNSKSQVFFKMNSLQSNDTAIYYCARALTYYDYEFAYWGQGTLVTVSA

SEQ ID NO: 11570 - protein, 119 aa, Artificial Sequence
  Description of Artificial Sequence: Synthetic polypeptide
  Variable HC K071A
QVQLKQSGPGLVQPSQSLSITCTVSGFSLTNYGVHWVRQSPGKGLEWLGVIWSGGNTDYNTPFTSRLSINADNSKSQVFFKMNSLQSNDTAIYYCARALTYYDYEFAYWGQGTLVTVSA

SEQ ID NO: 11571 - protein, 119 aa, Artificial Sequence
  Description of Artificial Sequence: Synthetic polypeptide
  Variable HC K071C
QVQLKQSGPGLVQPSQSLSITCTVSGFSLTNYGVHWVRQSPGKGLEWLGVIWSGGNTDYNTPFTSRLSINCDNSKSQVFFKMNSLQSNDTAIYYCARALTYYDYEFAYWGQGTLVTVSA

SEQ ID NO: 11572 - protein, 119 aa, Artificial Sequence
  Description of Artificial Sequence: Synthetic polypeptide
  Variable HC K071F
QVQLKQSGPGLVQPSQSLSITCTVSGFSLTNYGVHWVRQSPGKGLEWLGVIWSGGNTDYNTPFTSRLSINFDNSKSQVFFKMNSLQSNDTAIYYCARALTYYDYEFAYWGQGTLVTVSA

SEQ ID NO: 11573 - protein, 119 aa, Artificial Sequence
  Description of Artificial Sequence: Synthetic polypeptide
  Variable HC K071G
QVQLKQSGPGLVQPSQSLSITCTVSGFSLTNYGVHWVRQSPGKGLEWLGVIWSGGNTDYNTPFTSRLSINGDNSKSQVFFKMNSLQSNDTAIYYCARALTYYDYEFAYWGQGTLVTVSA

SEQ ID NO: 11574 - protein, 119 aa, Artificial Sequence
  Description of Artificial Sequence: Synthetic polypeptide
  Variable HC K071Q
QVQLKQSGPGLVQPSQSLSITCTVSGFSLTNYGVHWVRQSPGKGLEWLGVIWSGGNTDYNTPFTSRLSINQDNSKSQVFFKMNSLQSNDTAIYYCARALTYYDYEFAYWGQGTLVTVSA

SEQ ID NO: 11575 - protein, 119 aa, Artificial Sequence
  Description of Artificial Sequence: Synthetic polypeptide
  Variable HC K071S
QVQLKQSGPGLVQPSQSLSITCTVSGFSLTNYGVHWVRQSPGKGLEWLGVIWSGGNTDYNTPFTSRLSINSDNSKSQVFFKMNSLQSNDTAIYYCARALTYYDYEFAYWGQGTLVTVSA

SEQ ID NO: 11576 - protein, 119 aa, Artificial Sequence
  Description of Artificial Sequence: Synthetic polypeptide
  Variable HC K071T
QVQLKQSGPGLVQPSQSLSITCTVSGFSLTNYGVHWVRQSPGKGLEWLGVIWSGGNTDYNTPFTSRLSINTDNSKSQVFFKMNSLQSNDTAIYYCARALTYYDYEFAYWGQGTLVTVSA

SEQ ID NO: 11577 - protein, 119 aa, Artificial Sequence
  Description of Artificial Sequence: Synthetic polypeptide
  Variable HC K071V
QVQLKQSGPGLVQPSQSLSITCTVSGFSLTNYGVHWVRQSPGKGLEWLGVIWSGGNTDYNTPFTSRLSINVDNSKSQVFFKMNSLQSNDTAIYYCARALTYYDYEFAYWGQGTLVTVSA

SEQ ID NO: 11578 - protein, 119 aa, Artificial Sequence
  Description of Artificial Sequence: Synthetic polypeptide
  Variable HC K071W
QVQLKQSGPGLVQPSQSLSITCTVSGFSLTNYGVHWVRQSPGKGLEWLGVIWSGGNTDYNTPFTSRLSINWDNSKSQVFFKMNSLQSNDTAIYYCARALTYYDYEFAYWGQGTLVTVSA

SEQ ID NO: 11579 - protein, 119 aa, Artificial Sequence
  Description of Artificial Sequence: Synthetic polypeptide
  Variable HC K071Y
QVQLKQSGPGLVQPSQSLSITCTVSGFSLTNYGVHWVRQSPGKGLEWLGVIWSGGNTDYNTPFTSRLSINYDNSKSQVFFKMNSLQSNDTAIYYCARALTYYDYEFAYWGQGTLVTVSA

SEQ ID NO: 11580 - protein, 119 aa, Artificial Sequence
  Description of Artificial Sequence: Synthetic polypeptide
  Variable HC D072K
QVQLKQSGPGLVQPSQSLSITCTVSGFSLTNYGVHWVRQSPGKGLEWLGVIWSGGNTDYNTPFTSRLSINKKNSKSQVFFKMNSLQSNDTAIYYCARALTYYDYEFAYWGQGTLVTVSA

SEQ ID NO: 11581 - protein, 119 aa, Artificial Sequence
  Description of Artificial Sequence: Synthetic polypeptide
  Variable HC D072H
QVQLKQSGPGLVQPSQSLSITCTVSGFSLTNYGVHWVRQSPGKGLEWLGVIWSGGNTDYNTPFTSRLSINKHNSKSQVFFKMNSLQSNDTAIYYCARALTYYDYEFAYWGQGTLVTVSA

SEQ ID NO: 11582 - protein, 119 aa, Artificial Sequence
  Description of Artificial Sequence: Synthetic polypeptide
  Variable HC D072R
QVQLKQSGPGLVQPSQSLSITCTVSGFSLTNYGVHWVRQSPGKGLEWLGVIWSGGNTDYNTPFTSRLSINKRNSKSQVFFKMNSLQSNDTAIYYCARALTYYDYEFAYWGQGTLVTVSA

SEQ ID NO: 11583 - protein, 119 aa, Artificial Sequence
  Description of Artificial Sequence: Synthetic polypeptide
  Variable HC D072L
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDYEFAYWGQGTLVTVSA

SEQ ID NO: 11584 - protein, 119 aa, Artificial Sequence
  Description of Artificial Sequence: Synthetic polypeptide
  Variable HC D072A
QVQLKQSGPGLVQPSQSLSITCTVSGFSLTNYGVHWVRQSPGKGLEWLGVIWSGGNTDYNTPFTSRLSINKANSKSQVFFKMNSLQSNDTAIYYCARALTYYDYEFAYWGQGTLVTVSA

SEQ ID NO: 11585 - protein, 119 aa, Artificial Sequence
  Description of Artificial Sequence: Synthetic polypeptide
  Variable HC D072G
QVQLKQSGPGLVQPSQSLSITCTVSGFSLTNYGVHWVRQSPGKGLEWLGVIWSGGNTDYNTPFTSRLSINKGNSKSQVFFKMNSLQSNDTAIYYCARALTYYDYEFAYWGQGTLVTVSA

SEQ ID NO: 11586 - protein, 119 aa, Artificial Sequence
  Description of Artificial Sequence: Synthetic polypeptide
  Variable HC D072I
QVQLKQSGPGLVQPSQSLSITCTVSGFSLTNYGVHWVRQSPGKGLEWLGVIWSGGNTDYNTPFTSRLSINKINSKSQVFFKMNSLQSNDTAIYYCARALTYYDYEFAYWGQGTLVTVSA

SEQ ID NO: 11587 - protein, 119 aa, Artificial Sequence
  Description of Artificial Sequence: Synthetic polypeptide
  Variable HC D072M
QVQLKQSGPGLVQPSQSLSITCTVSGFSLTNYGVHWVRQSPGKGLEWLGVIWSGGNTDYNTPFTSRLSINKMNSKSQVFFKMNSLQSNDTAIYYCARALTYYDYEFAYWGQGTLVTVSA

SEQ ID NO: 11588 - protein, 119 aa, Artificial Sequence
  Description of Artificial Sequence: Synthetic polypeptide
  Variable HC D072N
QVQLKQSGPGLVQPSQSLSITCTVSGFSLTNYGVHWVRQSPGKGLEWLGVIWSGGNTDYNTPFTSRLSINKNNSKSQVFFKMNSLQSNDTAIYYCARALTYYDYEFAYWGQGTLVTVSA

SEQ ID NO: 11589 - protein, 119 aa, Artificial Sequence
  Description of Artificial Sequence: Synthetic polypeptide
  Variable HC D072Q
QVQLKQSGPGLVQPSQSLSITCTVSGFSLTNYGVHWVRQSPGKGLEWLGVIWSGGNTDYNTPFTSRLSINKQNSKSQVFFKMNSLQSNDTAIYYCARALTYYDYEFAYWGQGTLVTVSA

SEQ ID NO: 11590 - protein, 119 aa, Artificial Sequence
  Description of Artificial Sequence: Synthetic polypeptide
  Variable HC D072S
QVQLKQSGPGLVQPSQSLSITCTVSGFSLTNYGVHWVRQSPGKGLEWLGVIWSGGNTDYNTPFTSRLSINKSNSKSQVFFKMNSLQSNDTAIYYCARALTYYDYEFAYWGQGTLVTVSA

SEQ ID NO: 11591 - protein, 119 aa, Artificial Sequence
  Description of Artificial Sequence: Synthetic polypeptide
  Variable HC D072V
QVQLKQSGPGLVQPSQSLSITCTVSGFSLTNYGVHWVRQSPGKGLEWLGVIWSGGNTDYNTPFTSRLSINKVNSKSQVFFKMNSLQSNDTAIYYCARALTYYDYEFAYWGQGTLVTVSA

SEQ ID NO: 11592 - protein, 119 aa, Artificial Sequence
  Description of Artificial Sequence: Synthetic polypeptide
  Variable HC D072W
QVQLKQSGPGLVQPSQSLSITCTVSGFSLTNYGVHWVRQSPGKGLEWLGVIWSGGNTDYNTPFTSRLSINKWNSKSQVFFKMNSLQSNDTAIYYCARALTYYDYEFAYWGQGTLVTVSA

SEQ ID NO: 11593 - protein, 119 aa, Artificial Sequence
  Description of Artificial Sequence: Synthetic polypeptide
  Variable HC D072Y
QVQLKQSGPGLVQPSQSLSITCTVSGFSLTNYGVHWVRQSPGKGLEWLGVIWSGGNTDYNTPFTSRLSINKYNSKSQVFFKMNSLQSNDTAIYYCARALTYYDYEFAYWGQGTLVTVSA

SEQ ID NO: 11594 - protein, 119 aa, Artificial Sequence
  Description of Artificial Sequence: Synthetic polypeptide
  Variable HC N073H
QVQLKQSGPGLVQPSQSLSITCTVSGFSLTNYGVHWVRQSPGKGLEWLGVIWSGGNTDYNTPFTSRLSINKDHSKSQVFFKMNSLQSNDTAIYYCARALTYYDYEFAYWGQGTLVTVSA

SEQ ID NO: 11595 - protein, 119 aa, Artificial Sequence
  Description of Artificial Sequence: Synthetic polypeptide
  Variable HC N073R
QVQLKQSGPGLVQPSQSLSITCTVSGFSLTNYGVHWVRQSPGKGLEWLGVIWSGGNTDYNTPFTSRLSINKDRSKSQVFFKMNSLQSNDTAIYYCARALTYYDYEFAYWGQGTLVTVSA

SEQ ID NO: 11596 - protein, 119 aa, Artificial Sequence
  Description of Artificial Sequence: Synthetic polypeptide
  Variable HC N073L
QVQLKQSGPGLVQPSQSLSITCTVSGFSLTNYGVHWVRQSPGKGLEWLGVIWSGGNTDYNTPFTSRLSINKDLSKSQVFFKMNSLQSNDTAIYYCARALTYYDYEFAYWGQGTLVTVSA

SEQ ID NO: 11597 - protein, 119 aa, Artificial Sequence
  Description of Artificial Sequence: Synthetic polypeptide
  Variable HC N073A
QVQLKQSGPGLVQPSQSLSITCTVSGFSLTNYGVHWVRQSPGKGLEWLGVIWSGGNTDYNTPFTSRLSINKDASKSQVFFKMNSLQSNDTAIYYCARALTYYDYEFAYWGQGTLVTVSA

SEQ ID NO: 11598 - protein, 119 aa, Artificial Sequence
  Description of Artificial Sequence: Synthetic polypeptide
  Variable HC N073C
QVQLKQSGPGLVQPSQSLSITCTVSGFSLTNYGVHWVRQSPGKGLEWLGVIWSGGNTDYNTPFTSRLSINKDCSKSQVFFKMNSLQSNDTAIYYCARALTYYDYEFAYWGQGTLVTVSA

SEQ ID NO: 11599 - protein, 119 aa, Artificial Sequence
  Description of Artificial Sequence: Synthetic polypeptide
  Variable HC N073G
QVQLKQSGPGLVQPSQSLSITCTVSGFSLTNYGVHWVRQSPGKGLEWLGVIWSGGNTDYNTPFTSRLSINKDGSKSQVFFKMNSLQSNDTAIYYCARALTYYDYEFAYWGQGTLVTVSA

SEQ ID NO: 11600 - protein, 119 aa, Artificial Sequence
  Description of Artificial Sequence: Synthetic polypeptide
  Variable HC N073I
QVQLKQSGPGLVQPSQSLSITCTVSGFSLTNYGVHWVRQSPGKGLEWLGVIWSGGNTDYNTPFTSRLSINKDISKSQVFFKMNSLQSNDTAIYYCARALTYYDYEFAYWGQGTLVTVSA

SEQ ID NO: 11601 - protein, 119 aa, Artificial Sequence
  Description of Artificial Sequence: Synthetic polypeptide
  Variable HC N073M
QVQLKQSGPGLVQPSQSLSITCTVSGFSLTNYGVHWVRQSPGKGLEWLGVIWSGGNTDYNTPFTSRLSINKDMSKSQVFFKMNSLQSNDTAIYYCARALTYYDYEFAYWGQGTLVTVSA

SEQ ID NO: 11602 - protein, 119 aa, Artificial Sequence
  Description of Artificial Sequence: Synthetic polypeptide
  Variable HC N073P
QVQLKQSGPGLVQPSQSLSITCTVSGFSLTNYGVHWVRQSPGKGLEWLGVIWSGGNTDYNTPFTSRLSINKDPSKSQVFFKMNSLQSNDTAIYYCARALTYYDYEFAYWGQGTLVTVSA

SEQ ID NO: 11603 - protein, 119 aa, Artificial Sequence
  Description of Artificial Sequence: Synthetic polypeptide
  Variable HC N073Q
QVQLKQSGPGLVQPSQSLSITCTVSGFSLTNYGVHWVRQSPGKGLEWLGVIWSGGNTDYNTPFTSRLSINKDQSKSQVFFKMNSLQSNDTAIYYCARALTYYDYEFAYWGQGTLVTVSA

SEQ ID NO: 11604 - protein, 119 aa, Artificial Sequence
  Description of Artificial Sequence: Synthetic polypeptide
  Variable HC N073S
QVQLKQSGPGLVQPSQSLSITCTVSGFSLTNYGVHWVRQSPGKGLEWLGVIWSGGNTDYNTPFTSRLSINKDSSKSQVFFKMNSLQSNDTAIYYCARALTYYDYEFAYWGQGTLVTVSA

SEQ ID NO: 11605 - protein, 119 aa, Artificial Sequence
  Description of Artificial Sequence: Synthetic polypeptide
  Variable HC N073T
QVQLKQSGPGLVQPSQSLSITCTVSGFSLTNYGVHWVRQSPGKGLEWLGVIWSGGNTDYNTPFTSRLSINKDTSKSQVFFKMNSLQSNDTAIYYCARALTYYDYEFAYWGQGTLVTVSA

SEQ ID NO: 11606 - protein, 119 aa, Artificial Sequence
  Description of Artificial Sequence: Synthetic polypeptide
  Variable HC N073V
QVQLKQSGPGLVQPSQSLSITCTVSGFSLTNYGVHWVRQSPGKGLEWLGVIWSGGNTDYNTPFTSRLSINKDVSKSQVFFKMNSLQSNDTAIYYCARALTYYDYEFAYWGQGTLVTVSA

SEQ ID NO: 11607 - protein, 119 aa, Artificial Sequence
  Description of Artificial Sequence: Synthetic polypeptide
  Variable HC N073W
QVQLKQSGPGLVQPSQSLSITCTVSGFSLTNYGVHWVRQSPGKGLEWLGVIWSGGNTDYNTPFTSRLSINKDWSKSQVFFKMNSLQSNDTAIYYCARALTYYDYEFAYWGQGTLVTVSA

SEQ ID NO: 11608 - protein, 119 aa, Artificial Sequence
  Description of Artificial Sequence: Synthetic polypeptide
  Variable HC N073Y
QVQLKQSGPGLVQPSQSLSITCTVSGFSLTNYGVHWVRQSPGKGLEWLGVIWSGGNTDYNTPFTSRLSINKDYSKSQVFFKMNSLQSNDTAIYYCARALTYYDYEFAYWGQGTLVTVSA

SEQ ID NO: 11609 - protein, 119 aa, Artificial Sequence
  Description of Artificial Sequence: Synthetic polypeptide
  Variable HC S074K
QVQLKQSGPGLVQPSQSLSITCTVSGFSLTNYGVHWVRQSPGKGLEWLGVIWSGGNTDYNTPFTSRLSINKDNKKSQVFFKMNSLQSNDTAIYYCARALTYYDYEFAYWGQGTLVTVSA

SEQ ID NO: 11610 - protein, 119 aa, Artificial Sequence
  Description of Artificial Sequence: Synthetic polypeptide
  Variable HC S074H
QVQLKQSGPGLVQPSQSLSITCTVSGFSLTNYGVHWVRQSPGKGLEWLGVIWSGGNTDYNTPFTSRLSINKDNHKSQVFFKMNSLQSNDTAIYYCARALTYYDYEFAYWGQGTLVTVSA

SEQ ID NO: 11611 - protein, 119 aa, Artificial Sequence
  Description of Artificial Sequence: Synthetic polypeptide
  Variable HC S074R
QVQLKQSGPGLVQPSQSLSITCTVSGFSLTNYGVHWVRQSPGKGLEWLGVIWSGGNTDYNTPFTSRLSINKDNRKSQVFFKMNSLQSNDTAIYYCARALTYYDYEFAYWGQGTLVTVSA

SEQ ID NO: 11612 - protein, 119 aa, Artificial Sequence
  Description of Artificial Sequence: Synthetic polypeptide
  Variable HC S074L
QVQLKQSGPGLVQPSQSLSITCTVSGFSLTNYGVHWVRQSPGKGLEWLGVIWSGGNTDYNTPFTSRLSINKDNLKSQVFFKMNSLQSNDTAIYYCARALTYYDYEFAYWGQGTLVTVSA

SEQ ID NO: 11613 - protein, 119 aa, Artificial Sequence
  Description of Artificial Sequence: Synthetic polypeptide
  Variable HC S074A
QVQLKQSGPGLVQPSQSLSITCTVSGFSLTNYGVHWVRQSPGKGLEWLGVIWSGGNTDYNTPFTSRLSINKDNAKSQVFFKMNSLQSNDTAIYYCARALTYYDYEFAYWGQGTLVTVSA

SEQ ID NO: 11614 - protein, 119 aa, Artificial Sequence
  Description of Artificial Sequence: Synthetic polypeptide
  Variable HC S074C
QVQLKQSGPGLVQPSQSLSITCTVSGFSLTNYGVHWVRQSPGKGLEWLGVIWSGGNTDYNTPFTSRLSINKDNCKSQVFFKMNSLQSNDTAIYYCARALTYYDYEFAYWGQGTLVTVSA

SEQ ID NO: 11615 - protein, 119 aa, Artificial Sequence
  Description of Artificial Sequence: Synthetic polypeptide
  Variable HC S074D
QVQLKQSGPGLVQPSQSLSITCTVSGFSLTNYGVHWVRQSPGKGLEWLGVIWSGGNTDYNTPFTSRLSINKDNDKSQVFFKMNSLQSNDTAIYYCARALTYYDYEFAYWGQGTLVTVSA

SEQ ID NO: 11616 - protein, 119 aa, Artificial Sequence
  Description of Artificial Sequence: Synthetic polypeptide
  Variable HC S074E
QVQLKQSGPGLVQPSQSLSITCTVSGFSLTNYGVHWVRQSPGKGLEWLGVIWSGGNTDYNTPFTSRLSINKDNEKSQVFFKMNSLQSNDTAIYYCARALTYYDYEFAYWGQGTLVTVSA

SEQ ID NO: 11617 - protein, 119 aa, Artificial Sequence
  Description of Artificial Sequence: Synthetic polypeptide
  Variable HC S074G
QVQLKQSGPGLVQPSQSLSITCTVSGFSLTNYGVHWVRQSPGKGLEWLGVIWSGGNTDYNTPFTSRLSINKDNGKSQVFFKMNSLQSNDTAIYYCARALTYYDYEFAYWGQGTLVTVSA

SEQ ID NO: 11618 - protein, 119 aa, Artificial Sequence
  Description of Artificial Sequence: Synthetic polypeptide
  Variable HC S074I
QVQLKQSGPGLVQPSQSLSITCTVSGFSLTNYGVHWVRQSPGKGLEWLGVIWSGGNTDYNTPFTSRLSINKDNIKSQVFFKMNSLQSNDTAIYYCARALTYYDYEFAYWGQGTLVTVSA

SEQ ID NO: 11619 - protein, 119 aa, Artificial Sequence
  Description of Artificial Sequence: Synthetic polypeptide
  Variable HC S074M
QVQLKQSGPGLVQPSQSLSITCTVSGFSLTNYGVHWVRQSPGKGLEWLGVIWSGGNTDYNTPFTSRLSINKDNMKSQVFFKMNSLQSNDTAIYYCARALTYYDYEFAYWGQGTLVTVSA

SEQ ID NO: 11620 - protein, 119 aa, Artificial Sequence
  Description of Artificial Sequence: Synthetic polypeptide
  Variable HC S074P
QVQLKQSGPGLVQPSQSLSITCTVSGFSLTNYGVHWVRQSPGKGLEWLGVIWSGGNTDYNTPFTSRLSINKDNPKSQVFFKMNSLQSNDTAIYYCARALTYYDYEFAYWGQGTLVTVSA

SEQ ID NO: 11621 - protein, 119 aa, Artificial Sequence
  Description of Artificial Sequence: Synthetic polypeptide
  Variable HC S074T
QVQLKQSGPGLVQPSQSLSITCTVSGFSLTNYGVHWVRQSPGKGLEWLGVIWSGGNTDYNTPFTSRLSINKDNTKSQVFFKMNSLQSNDTAIYYCARALTYYDYEFAYWGQGTLVTVSA

SEQ ID NO: 11622 - protein, 119 aa, Artificial Sequence
  Description of Artificial Sequence: Synthetic polypeptide
  Variable HC S074V
QVQLKQSGPGLVQPSQSLSITCTVSGFSLTNYGVHWVRQSPGKGLEWLGVIWSGGNTDYNTPFTSRLSINKDNVKSQVFFKMNSLQSNDTAIYYCARALTYYDYEFAYWGQGTLVTVSA

SEQ ID NO: 11623 - protein, 119 aa, Artificial Sequence
  Description of Artificial Sequence: Synthetic polypeptide
  Variable HC S074Y
QVQLKQSGPGLVQPSQSLSITCTVSGFSLTNYGVHWVRQSPGKGLEWLGVIWSGGNTDYNTPFTSRLSINKDNYKSQVFFKMNSLQSNDTAIYYCARALTYYDYEFAYWGQGTLVTVSA

SEQ ID NO: 11624 - protein, 119 aa, Artificial Sequence
  Description of Artificial Sequence: Synthetic polypeptide
  Variable HC K075H
QVQLKQSGPGLVQPSQSLSITCTVSGFSLTNYGVHWVRQSPGKGLEWLGVIWSGGNTDYNTPFTSRLSINKDNSHSQVFFKMNSLQSNDTAIYYCARALTYYDYEFAYWGQGTLVTVSA

SEQ ID NO: 11625 - protein, 119 aa, Artificial Sequence
  Description of Artificial Sequence: Synthetic polypeptide
  Variable HC K075R
QVQLKQSGPGLVQPSQSLSITCTVSGFSLTNYGVHWVRQSPGKGLEWLGVIWSGGNTDYNTPFTSRLSINKDNSRSQVFFKMNSLQSNDTAIYYCARALTYYDYEFAYWGQGTLVTVSA

SEQ ID NO: 11626 - protein, 119 aa, Artificial Sequence
  Description of Artificial Sequence: Synthetic polypeptide
  Variable HC K075L
QVQLKQSGPGLVQPSQSLSITCTVSGFSLTNYGVHWVRQSPGKGLEWLGVIWSGGNTDYNTPFTSRLSINKDNSLSQVFFKMNSLQSNDTAIYYCARALTYYDYEFAYWGQGTLVTVSA

SEQ ID NO: 11627 - protein, 119 aa, Artificial Sequence
  Description of Artificial Sequence: Synthetic polypeptide
  Variable HC K075A
QVQLKQSGPGLVQPSQSLSITCTVSGFSLTNYGVHWVRQSPGKGLEWLGVIWSGGNTDYNTPFTSRLSINKDNSASQVFFKMNSLQSNDTAIYYCARALTYYDYEFAYWGQGTLVTVSA

SEQ ID NO: 11628 - protein, 119 aa, Artificial Sequence
  Description of Artificial Sequence: Synthetic polypeptide
  Variable HC K075C
QVQLKQSGPGLVQPSQSLSITCTVSGFSLTNYGVHWVRQSPGKGLEWLGVIWSGGNTDYNTPFTSRLSINKDNSCSQVFFKMNSLQSNDTAIYYCARALTYYDYEFAYWGQGTLVTVSA

SEQ ID NO: 11629 - protein, 119 aa, Artificial Sequence
  Description of Artificial Sequence: Synthetic polypeptide
  Variable HC K075E
QVQLKQSGPGLVQPSQSLSITCTVSGFSLTNYGVHWVRQSPGKGLEWLGVIWSGGNTDYNTPFTSRLSINKDNSESQVFFKMNSLQSNDTAIYYCARALTYYDYEFAYWGQGTLVTVSA

SEQ ID NO: 11630 - protein, 119 aa, Artificial Sequence
  Description of Artificial Sequence: Synthetic polypeptide
  Variable HC K075F
QVQLKQSGPGLVQPSQSLSITCTVSGFSLTNYGVHWVRQSPGKGLEWLGVIWSGGNTDYNTPFTSRLSINKDNSFSQVFFKMNSLQSNDTAIYYCARALTYYDYEFAYWGQGTLVTVSA

SEQ ID NO: 11631 - protein, 119 aa, Artificial Sequence
  Description of Artificial Sequence: Synthetic polypeptide
  Variable HC K075M
QVQLKQSGPGLVQPSQSLSITCTVSGFSLTNYGVHWVRQSPGKGLEWLGVIWSGGNTDYNTPFTSRLSINKDNSMSQVFFKMNSLQSNDTAIYYCARALTYYDYEFAYWGQGTLVTVSA

SEQ ID NO: 11632 - protein, 119 aa, Artificial Sequence
  Description of Artificial Sequence: Synthetic polypeptide
  Variable HC K075Q
QVQLKQSGPGLVQPSQSLSITCTVSGFSLTNYGVHWVRQSPGKGLEWLGVIWSGGNTDYNTPFTSRLSINKDNSQSQVFFKMNSLQSNDTAIYYCARALTYYDYEFAYWGQGTLVTVSA

SEQ ID NO: 11633 - protein, 119 aa, Artificial Sequence
  Description of Artificial Sequence: Synthetic polypeptide
  Variable HC K075T
QVQLKQSGPGLVQPSQSLSITCTVSGFSLTNYGVHWVRQSPGKGLEWLGVIWSGGNTDYNTPFTSRLSINKDNSTSQVFFKMNSLQSNDTAIYYCARALTYYDYEFAYWGQGTLVTVSA

SEQ ID NO: 11634 - protein, 119 aa, Artificial Sequence
  Description of Artificial Sequence: Synthetic polypeptide
  Variable HC K075V
QVQLKQSGPGLVQPSQSLSITCTVSGFSLTNYGVHWVRQSPGKGLEWLGVIWSGGNTDYNTPFTSRLSINKDNSVSQVFFKMNSLQSNDTAIYYCARALTYYDYEFAYWGQGTLVTVSA

SEQ ID NO: 11635 - protein, 119 aa, Artificial Sequence
  Description of Artificial Sequence: Synthetic polypeptide
  Variable HC K075W
QVQLKQSGPGLVQPSQSLSITCTVSGFSLTNYGVHWVRQSPGKGLEWLGVIWSGGNTDYNTPFTSRLSINKDNSWSQVFFKMNSLQSNDTAIYYCARALTYYDYEFAYWGQGTLVTVSA

SEQ ID NO: 11636 - protein, 119 aa, Artificial Sequence
  Description of Artificial Sequence: Synthetic polypeptide
  Variable HC K075Y
QVQLKQSGPGLVQPSQSLSITCTVSGFSLTNYGVHWVRQSPGKGLEWLGVIWSGGNTDYNTPFTSRLSINKDNSYSQVFFKMNSLQSNDTAIYYCARALTYYDYEFAYWGQGTLVTVSA

SEQ ID NO: 11637 - protein, 119 aa, Artificial Sequence
  Description of Artificial Sequence: Synthetic polypeptide
  Variable HC S076H
QVQLKQSGPGLVQPSQSLSITCTVSGFSLTNYGVHWVRQSPGKGLEWLGVIWSGGNTDYNTPFTSRLSINKDNSKHQVFFKMNSLQSNDTAIYYCARALTYYDYEFAYWGQGTLVTVSA

SEQ ID NO: 11638 - protein, 119 aa, Artificial Sequence
  Description of Artificial Sequence: Synthetic polypeptide
  Variable HC S076R
QVQLKQSGPGLVQPSQSLSITCTVSGFSLTNYGVHWVRQSPGKGLEWLGVIWSGGNTDYNTPFTSRLSINKDNSKRQVFFKMNSLQSNDTAIYYCARALTYYDYEFAYWGQGTLVTVSA

SEQ ID NO: 11639 - protein, 119 aa, Artificial Sequence
  Description of Artificial Sequence: Synthetic polypeptide
  Variable HC S076L
QVQLKQSGPGLVQPSQSLSITCTVSGFSLTNYGVHWVRQSPGKGLEWLGVIWSGGNTDYNTPFTSRLSINKDNSKLQVFFKMNSLQSNDTAIYYCARALTYYDYEFAYWGQGTLVTVSA

SEQ ID NO: 11640 - protein, 119 aa, Artificial Sequence
  Description of Artificial Sequence: Synthetic polypeptide
  Variable HC S076A
QVQLKQSGPGLVQPSQSLSITCTVSGFSLTNYGVHWVRQSPGKGLEWLGVIWSGGNTDYNTPFTSRLSINKDNSKAQVFFKMNSLQSNDTAIYYCARALTYYDYEFAYWGQGTLVTVSA

SEQ ID NO: 11641 - protein, 119 aa, Artificial Sequence
  Description of Artificial Sequence: Synthetic polypeptide
  Variable HC S076C
QVQLKQSGPGLVQPSQSLSITCTVSGFSLTNYGVHWVRQSPGKGLEWLGVIWSGGNTDYNTPFTSRLSINKDNSKCQVFFKMNSLQSNDTAIYYCARALTYYDYEFAYWGQGTLVTVSA

SEQ ID NO: 11642 - protein, 119 aa, Artificial Sequence
  Description of Artificial Sequence: Synthetic polypeptide
  Variable HC S076D
QVQLKQSGPGLVQPSQSLSITCTVSGFSLTNYGVHWVRQSPGKGLEWLGVIWSGGNTDYNTPFTSRLSINKDNSKDQVFFKMNSLQSNDTAIYYCARALTYYDYEFAYWGQGTLVTVSA

SEQ ID NO: 11643 - protein, 119 aa, Artificial Sequence
  Description of Artificial Sequence: Synthetic polypeptide
  Variable HC S076E
QVQLKQSGPGLVQPSQSLSITCTVSGFSLTNYGVHWVRQSPGKGLEWLGVIWSGGNTDYNTPFTSRLSINKDNSKEQVFFKMNSLQSNDTAIYYCARALTYYDYEFAYWGQGTLVTVSA

SEQ ID NO: 11644 - protein, 119 aa, Artificial Sequence
  Description of Artificial Sequence: Synthetic polypeptide
  Variable HC S076F
QVQLKQSGPGLVQPSQSLSITCTVSGFSLTNYGVHWVRQSPGKGLEWLGVIWSGGNTDYNTPFTSRLSINKDNSKFQVFFKMNSLQSNDTAIYYCARALTYYDYEFAYWGQGTLVTVSA

SEQ ID NO: 11645 - protein, 119 aa, Artificial Sequence
  Description of Artificial Sequence: Synthetic polypeptide
  Variable HC S076M
QVQLKQSGPGLVQPSQSLSITCTVSGFSLTNYGVHWVRQSPGKGLEWLGVIWSGGNTDYNTPFTSRLSINKDNSKMQVFFKMNSLQSNDTAIYYCARALTYYDYEFAYWGQGTLVTVSA

SEQ ID NO: 11646 - protein, 119 aa, Artificial Sequence
  Description of Artificial Sequence: Synthetic polypeptide
  Variable HC S076P
QVQLKQSGPGLVQPSQSLSITCTVSGFSLTNYGVHWVRQSPGKGLEWLGVIWSGGNTDYNTPFTSRLSINKDNSKPQVFFKMNSLQSNDTAIYYCARALTYYDYEFAYWGQGTLVTVSA

SEQ ID NO: 11647 - protein, 119 aa, Artificial Sequence
  Description of Artificial Sequence: Synthetic polypeptide
  Variable HC S076Q
QVQLKQSGPGLVQPSQSLSITCTVSGFSLTNYGVHWVRQSPGKGLEWLGVIWSGGNTDYNTPFTSRLSINKDNSKQQVFFKMNSLQSNDTAIYYCARALTYYDYEFAYWGQGTLVTVSA

SEQ ID NO: 11648 - protein, 119 aa, Artificial Sequence
  Description of Artificial Sequence: Synthetic polypeptide
  Variable HC S076T
QVQLKQSGPGLVQPSQSLSITCTVSGFSLTNYGVHWVRQSPGKGLEWLGVIWSGGNTDYNTPFTSRLSINKDNSKTQVFFKMNSLQSNDTAIYYCARALTYYDYEFAYWGQGTLVTVSA

SEQ ID NO: 11649 - protein, 119 aa, Artificial Sequence
  Description of Artificial Sequence: Synthetic polypeptide
  Variable HC S076Y
QVQLKQSGPGLVQPSQSLSITCTVSGFSLTNYGVHWVRQSPGKGLEWLGVIWSGGNTDYNTPFTSRLSINKDNSKYQVFFKMNSLQSNDTAIYYCARALTYYDYEFAYWGQGTLVTVSA

SEQ ID NO: 11650 - protein, 119 aa, Artificial Sequence
  Description of Artificial Sequence: Synthetic polypeptide
  Variable HC Q077H
QVQLKQSGPGLVQPSQSLSITCTVSGFSLTNYGVHWVRQSPGKGLEWLGVIWSGGNTDYNTPFTSRLSINKDNSKSHVFFKMNSLQSNDTAIYYCARALTYYDYEFAYWGQGTLVTVSA

SEQ ID NO: 11651 - protein, 119 aa, Artificial Sequence
  Description of Artificial Sequence: Synthetic polypeptide
  Variable HC Q077R
QVQLKQSGPGLVQPSQSLSITCTVSGFSLTNYGVHWVRQSPGKGLEWLGVIWSGGNTDYNTPFTSRLSINKDNSKSRVFFKMNSLQSNDTAIYYCARALTYYDYEFAYWGQGTLVTVSA

SEQ ID NO: 11652 - protein, 119 aa, Artificial Sequence
  Description of Artificial Sequence: Synthetic polypeptide
  Variable HC Q077L
QVQLKQSGPGLVQPSQSLSITCTVSGFSLTNYGVHWVRQSPGKGLEWLGVIWSGGNTDYNTPFTSRLSINKDNSKSLVFFKMNSLQSNDTAIYYCARALTYYDYEFAYWGQGTLVTVSA

SEQ ID NO: 11653 - protein, 119 aa, Artificial Sequence
  Description of Artificial Sequence: Synthetic polypeptide
  Variable HC Q077A
QVQLKQSGPGLVQPSQSLSITCTVSGFSLTNYGVHWVRQSPGKGLEWLGVIWSGGNTDYNTPFTSRLSINKDNSKSAVFFKMNSLQSNDTAIYYCARALTYYDYEFAYWGQGTLVTVSA

SEQ ID NO: 11654 - protein, 119 aa, Artificial Sequence
  Description of Artificial Sequence: Synthetic polypeptide
  Variable HC Q077E
QVQLKQSGPGLVQPSQSLSITCTVSGFSLTNYGVHWVRQSPGKGLEWLGVIWSGGNTDYNTPFTSRLSINKDNSKSEVFFKMNSLQSNDTAIYYCARALTYYDYEFAYWGQGTLVTVSA

SEQ ID NO: 11655 - protein, 119 aa, Artificial Sequence
  Description of Artificial Sequence: Synthetic polypeptide
  Variable HC Q077G
QVQLKQSGPGLVQPSQSLSITCTVSGFSLTNYGVHWVRQSPGKGLEWLGVIWSGGNTDYNTPFTSRLSINKDNSKSGVFFKMNSLQSNDTAIYYCARALTYYDYEFAYWGQGTLVTVSA

SEQ ID NO: 11656 - protein, 119 aa, Artificial Sequence
  Description of Artificial Sequence: Synthetic polypeptide
  Variable HC Q077I
QVQLKQSGPGLVQPSQSLSITCTVSGFSLTNYGVHWVRQSPGKGLEWLGVIWSGGNTDYNTPFTSRLSINKDNSKSIVFFKMNSLQSNDTAIYYCARALTYYDYEFAYWGQGTLVTVSA

SEQ ID NO: 11657 - protein, 119 aa, Artificial Sequence
  Description of Artificial Sequence: Synthetic polypeptide
  Variable HC Q077M
QVQLKQSGPGLVQPSQSLSITCTVSGFSLTNYGVHWVRQSPGKGLEWLGVIWSGGNTDYNTPFTSRLSINKDNSKSMVFFKMNSLQSNDTAIYYCARALTYYDYEFAYWGQGTLVTVSA

SEQ ID NO: 11658 - protein, 119 aa, Artificial Sequence
  Description of Artificial Sequence: Synthetic polypeptide
  Variable HC Q077N
QVQLKQSGPGLVQPSQSLSITCTVSGFSLTNYGVHWVRQSPGKGLEWLGVIWSGGNTDYNTPFTSRLSINKDNSKSNVFFKMNSLQSNDTAIYYCARALTYYDYEFAYWGQGTLVTVSA

SEQ ID NO: 11659 - protein, 119 aa, Artificial Sequence
  Description of Artificial Sequence: Synthetic polypeptide
  Variable HC Q077S
QVQLKQSGPGLVQPSQSLSITCTVSGFSLTNYGVHWVRQSPGKGLEWLGVIWSGGNTDYNTPFTSRLSINKDNSKSSVFFKMNSLQSNDTAIYYCARALTYYDYEFAYWGQGTLVTVSA

SEQ ID NO: 11660 - protein, 119 aa, Artificial Sequence
  Description of Artificial Sequence: Synthetic polypeptide
  Variable HC Q077V
QVQLKQSGPGLVQPSQSLSITCTVSGFSLTNYGVHWVRQSPGKGLEWLGVIWSGGNTDYNTPFTSRLSINKDNSKSVVFFKMNSLQSNDTAIYYCARALTYYDYEFAYWGQGTLVTVSA

SEQ ID NO: 11661 - protein, 119 aa, Artificial Sequence
  Description of Artificial Sequence: Synthetic polypeptide
  Variable HC Q077W
QVQLKQSGPGLVQPSQSLSITCTVSGFSLTNYGVHWVRQSPGKGLEWLGVIWSGGNTDYNTPFTSRLSINKDNSKSWVFFKMNSLQSNDTAIYYCARALTYYDYEFAYWGQGTLVTVSA

SEQ ID NO: 11662 - protein, 119 aa, Artificial Sequence
  Description of Artificial Sequence: Synthetic polypeptide
  Variable HC Q077Y
QVQLKQSGPGLVQPSQSLSITCTVSGFSLTNYGVHWVRQSPGKGLEWLGVIWSGGNTDYNTPFTSRLSINKDNSKSYVFFKMNSLQSNDTAIYYCARALTYYDYEFAYWGQGTLVTVSA

SEQ ID NO: 11663 - protein, 119 aa, Artificial Sequence
  Description of Artificial Sequence: Synthetic polypeptide
  Variable HC Y093H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIHYCARALTYYDYEFAYWGQGTLVTVSA

SEQ ID NO: 11664 - protein, 119 aa, Artificial Sequence
  Description of Artificial Sequence: Synthetic polypeptide
  Variable HC Y093V
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIVYCARALTYYDYEFAYWGQGTLVTVSA

SEQ ID NO: 11665 - protein, 119 aa, Artificial Sequence
  Description of Artificial Sequence: Synthetic polypeptide
  Variable HC Y093W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIWYCARALTYYDYEFAYWGQGTLVTVSA

SEQ ID NO: 11666 - protein, 119 aa, Artificial Sequence
  Description of Artificial Sequence: Synthetic polypeptide
  Variable HC Y094R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYRCARALTYYDYEFAYWGQGTLVTVSA

SEQ ID NO: 11667 - protein, 119 aa, Artificial Sequence
  Description of Artificial Sequence: Synthetic polypeptide
  Variable HC Y094L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYLCARALTYYDYEFAYWGQGTLVTVSA

SEQ ID NO: 11668 - protein, 119 aa, Artificial Sequence
  Description of Artificial Sequence: Synthetic polypeptide
  Variable HC R097H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCAHALTYYDYEFAYWGQGTLVTVSA

SEQ ID NO: 11669 - protein, 119 aa, Artificial Sequence
  Description of Artificial Sequence: Synthetic polypeptide
  Variable HC R097W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCAWALTYYDYEFAYWGQGTLVTVSA

SEQ ID NO: 11670 - protein, 117 aa, Artificial Sequence
  Description of Artificial Sequence: Synthetic polypeptide
  Variable HC A098P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARPLTYYDYEFAYWGQGTLVTV

SEQ ID NO: 11671 - protein, 119 aa, Artificial Sequence
  Description of Artificial Sequence: Synthetic polypeptide
  Variable HC L099N
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARANTYYDYEFAYWGQGTLVTVSA

SEQ ID NO: 11672 - protein, 119 aa, Artificial Sequence
  Description of Artificial Sequence: Synthetic polypeptide
  Variable HC L099W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARAWTYYDYEFAYWGQGTLVTVSA

SEQ ID NO: 11673 - protein, 119 aa, Artificial Sequence
  Description of Artificial Sequence: Synthetic polypeptide
  Variable HC T100H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALHYYDYEFAYWGQGTLVTVSA

SEQ ID NO: 11674 - protein, 119 aa, Artificial Sequence
  Description of Artificial Sequence: Synthetic polypeptide
  Variable HC T100L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALLYYDYEFAYWGQGTLVTVSA

SEQ ID NO: 11675 - protein, 119 aa, Artificial Sequence
  Description of Artificial Sequence: Synthetic polypeptide
  Variable HC T100A
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALAYYDYEFAYWGQGTLVTVSA

SEQ ID NO: 11676 - protein, 119 aa, Artificial Sequence
  Description of Artificial Sequence: Synthetic polypeptide
  Variable HC T100D
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALDYYDYEFAYWGQGTLVTVSA

SEQ ID NO: 11677 - protein, 119 aa, Artificial Sequence
  Description of Artificial Sequence: Synthetic polypeptide
  Variable HC T100I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALIYYDYEFAYWGQGTLVTVSA

SEQ ID NO: 11678 - protein, 119 aa, Artificial Sequence
  Description of Artificial Sequence: Synthetic polypeptide
  Variable HC T100N
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALNYYDYEFAYWGQGTLVTVSA

SEQ ID NO: 11679 - protein, 119 aa, Artificial Sequence
  Description of Artificial Sequence: Synthetic polypeptide
  Variable HC T100P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALPYYDYEFAYWGQGTLVTVSA

SEQ ID NO: 11680 - protein, 119 aa, Artificial Sequence
  Description of Artificial Sequence: Synthetic polypeptide
  Variable HC T100Q
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALQYYDYEFAYWGQGTLVTVSA

SEQ ID NO: 11681 - protein, 119 aa, Artificial Sequence
  Description of Artificial Sequence: Synthetic polypeptide
  Variable HC T100S
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALSYYDYEFAYWGQGTLVTVSA

SEQ ID NO: 11682 - protein, 119 aa, Artificial Sequence
  Description of Artificial Sequence: Synthetic polypeptide
  Variable HC T100V
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALVYYDYEFAYWGQGTLVTVSA

SEQ ID NO: 11683 - protein, 119 aa, Artificial Sequence
  Description of Artificial Sequence: Synthetic polypeptide
  Variable HC T100Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALYYYDYEFAYWGQGTLVTVSA

SEQ ID NO: 11684 - protein, 119 aa, Artificial Sequence
  Description of Artificial Sequence: Synthetic polypeptide
  Variable HC Y101H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTHYDYEFAYWGQGTLVTVSA

SEQ ID NO: 11685 - protein, 119 aa, Artificial Sequence
  Description of Artificial Sequence: Synthetic polypeptide
  Variable HC Y101E
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTEYDYEFAYWGQGTLVTVSA

SEQ ID NO: 11686 - protein, 119 aa, Artificial Sequence
  Description of Artificial Sequence: Synthetic polypeptide
  Variable HC Y101F
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTFYDYEFAYWGQGTLVTVSA

SEQ ID NO: 11687 - protein, 119 aa, Artificial Sequence
  Description of Artificial Sequence: Synthetic polypeptide
  Variable HC Y101M
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTMYDYEFAYWGQGTLVTVSA

SEQ ID NO: 11688 - protein, 119 aa, Artificial Sequence
  Description of Artificial Sequence: Synthetic polypeptide
  Variable HC Y101W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTWYDYEFAYWGQGTLVTVSA

SEQ ID NO: 11689 - protein, 119 aa, Artificial Sequence
  Description of Artificial Sequence: Synthetic polypeptide
  Variable HC Y102R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYRDYEFAYWGQGTLVTVSA

SEQ ID NO: 11690 - protein, 119 aa, Artificial Sequence
  Description of Artificial Sequence: Synthetic polypeptide
  Variable HC Y102C
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYCDYEFAYWGQGTLVTVSA

SEQ ID NO: 11691 - protein, 119 aa, Artificial Sequence
  Description of Artificial Sequence: Synthetic polypeptide
  Variable HC Y102D
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYDDYEFAYWGQGTLVTVSA

SEQ ID NO: 11692 - protein, 119 aa, Artificial Sequence
  Description of Artificial Sequence: Synthetic polypeptide
  Variable HC Y102I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYIDYEFAYWGQGTLVTVSA

SEQ ID NO: 11693 - protein, 119 aa, Artificial Sequence
  Description of Artificial Sequence: Synthetic polypeptide
  Variable HC Y102N
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYNDYEFAYWGQGTLVTVSA

SEQ ID NO: 11694 - protein, 119 aa, Artificial Sequence
  Description of Artificial Sequence: Synthetic polypeptide
  Variable HC Y102W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYWDYEFAYWGQGTLVTVSA

SEQ ID NO: 11695 - protein, 119 aa, Artificial Sequence
  Description of Artificial Sequence: Synthetic polypeptide
  Variable HC D103R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYRYEFAYWGQGTLVTVSA

SEQ ID NO: 11696 - protein, 119 aa, Artificial Sequence
  Description of Artificial Sequence: Synthetic polypeptide
  Variable HC D103L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYLYEFAYWGQGTLVTVSA

SEQ ID NO: 11697 - protein, 119 aa, Artificial Sequence
  Description of Artificial Sequence: Synthetic polypeptide
  Variable HC D103A
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYAYEFAYWGQGTLVTVSA

SEQ ID NO: 11698 - protein, 119 aa, Artificial Sequence
  Description of Artificial Sequence: Synthetic polypeptide
  Variable HC D103C
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYCYEFAYWGQGTLVTVSA

SEQ ID NO: 11699 - protein, 119 aa, Artificial Sequence
  Description of Artificial Sequence: Synthetic polypeptide
  Variable HC D103I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYIYEFAYWGQGTLVTVSA

SEQ ID NO: 11700 - protein, 119 aa, Artificial Sequence
  Description of Artificial Sequence: Synthetic polypeptide
  Variable HC D103P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYPYEFAYWGQGTLVTVSA

SEQ ID NO: 11701 - protein, 119 aa, Artificial Sequence
  Description of Artificial Sequence: Synthetic polypeptide
  Variable HC D103Q
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYQYEFAYWGQGTLVTVSA

SEQ ID NO: 11702 - protein, 119 aa, Artificial Sequence
  Description of Artificial Sequence: Synthetic polypeptide
  Variable HC D103Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYYYEFAYWGQGTLVTVSA

SEQ ID NO: 11703 - protein, 119 aa, Artificial Sequence
  Description of Artificial Sequence: Synthetic polypeptide
  Variable HC Y104H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDHEFAYWGQGTLVTVSA

SEQ ID NO: 11704 - protein, 119 aa, Artificial Sequence
  Description of Artificial Sequence: Synthetic polypeptide
  Variable HC Y104L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDLEFAYWGQGTLVTVSA

SEQ ID NO: 11705 - protein, 119 aa, Artificial Sequence
  Description of Artificial Sequence: Synthetic polypeptide
  Variable HC Y104D
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 11706 - protein, 119 aa, Artificial Sequence
  Description of Artificial Sequence: Synthetic polypeptide
  Variable HC Y104F
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDFEFAYWGQGTLVTVSA

SEQ ID NO: 11707 - protein, 119 aa, Artificial Sequence
  Description of Artificial Sequence: Synthetic polypeptide
  Variable HC Y104I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDIEFAYWGQGTLVTVSA

SEQ ID NO: 11708 - protein, 119 aa, Artificial Sequence
  Description of Artificial Sequence: Synthetic polypeptide
  Variable HC Y104M
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDMEFAYWGQGTLVTVSA

SEQ ID NO: 11709 - protein, 119 aa, Artificial Sequence
  Description of Artificial Sequence: Synthetic polypeptide
  Variable HC Y104S
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDSEFAYWGQGTLVTVSA

SEQ ID NO: 11710 - protein, 119 aa, Artificial Sequence
  Description of Artificial Sequence: Synthetic polypeptide
  Variable HC Y104V
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDVEFAYWGQGTLVTVSA

SEQ ID NO: 11711 - protein, 119 aa, Artificial Sequence
  Description of Artificial Sequence: Synthetic polypeptide
  Variable HC E105H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYHFAYWGQGTLVTVSA

SEQ ID NO: 11712 - protein, 119 aa, Artificial Sequence
  Description of Artificial Sequence: Synthetic polypeptide
  Variable HC E105T
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYTFAYWGQGTLVTVSA

SEQ ID NO: 11713 - protein, 119 aa, Artificial Sequence
  Description of Artificial Sequence: Synthetic polypeptide
  Variable HC F106L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYELAYWGQGTLVTVSA

SEQ ID NO: 11714 - protein, 119 aa, Artificial Sequence
  Description of Artificial Sequence: Synthetic polypeptide
  Variable HC F106V
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEVAYWGQGTLVTVSA

SEQ ID NO: 11715 - protein, 119 aa, Artificial Sequence
  Description of Artificial Sequence: Synthetic polypeptide
  Variable HC F106W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEWAYWGQGTLVTVSA

SEQ ID NO: 11716 - protein, 119 aa, Artificial Sequence
  Description of Artificial Sequence: Synthetic polypeptide
  Variable HC F106Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEYAYWGQGTLVTVSA

SEQ ID NO: 11717 - protein, 119 aa, Artificial Sequence
  Description of Artificial Sequence: Synthetic polypeptide
  Variable HC A107K
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFKYWGQGTLVTVSA

SEQ ID NO: 11718 - protein, 119 aa, Artificial Sequence
  Description of Artificial Sequence: Synthetic polypeptide
  Variable HC A107H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFHYWGQGTLVTVSA

SEQ ID NO: 11719 - protein, 119 aa, Artificial Sequence
  Description of Artificial Sequence: Synthetic polypeptide
  Variable HC A107R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFRYWGQGTLVTVSA

SEQ ID NO: 11720 - protein, 119 aa, Artificial Sequence
  Description of Artificial Sequence: Synthetic polypeptide
  Variable HC A107L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFLYWGQGTLVTVSA

SEQ ID NO: 11721 - protein, 119 aa, Artificial Sequence
  Description of Artificial Sequence: Synthetic polypeptide
  Variable HC A107C
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFCYWGQGTLVTVSA

SEQ ID NO: 11722 - protein, 119 aa, Artificial Sequence
  Description of Artificial Sequence: Synthetic polypeptide
  Variable HC A107D
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFDYWGQGTLVTVSA

SEQ ID NO: 11723 - protein, 119 aa, Artificial Sequence
  Description of Artificial Sequence: Synthetic polypeptide
  Variable HC A107E
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFEYWGQGTLVTVSA

SEQ ID NO: 11724 - protein, 119 aa, Artificial Sequence
  Description of Artificial Sequence: Synthetic polypeptide
  Variable HC A107G
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFGYWGQGTLVTVSA

SEQ ID NO: 11725 - protein, 119 aa, Artificial Sequence
  Description of Artificial Sequence: Synthetic polypeptide
  Variable HC A107N
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFNYWGQGTLVTVSA

SEQ ID NO: 11726 - protein, 119 aa, Artificial Sequence
  Description of Artificial Sequence: Synthetic polypeptide
  Variable HC A107S
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFSYWGQGTLVTVSA

SEQ ID NO: 11727 - protein, 119 aa, Artificial Sequence
  Description of Artificial Sequence: Synthetic polypeptide
  Variable HC A107T
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFTYWGQGTLVTVSA

SEQ ID NO: 11728 - protein, 119 aa, Artificial Sequence
  Description of Artificial Sequence: Synthetic polypeptide
  Variable HC A107Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFYYWGQGTLVTVSA

SEQ ID NO: 11729 - protein, 119 aa, Artificial Sequence
  Description of Artificial Sequence: Synthetic polypeptide
  Variable HC Y108K
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAKWGQGTLVTVSA

SEQ ID NO: 11730 - protein, 119 aa, Artificial Sequence
  Description of Artificial Sequence: Synthetic polypeptide
  Variable HC Y108H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAHWGQGTLVTVSA

SEQ ID NO: 11731 - protein, 119 aa, Artificial Sequence
  Description of Artificial Sequence: Synthetic polypeptide
  Variable HC Y108R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFARWGQGTLVTVSA

SEQ ID NO: 11732 - protein, 119 aa, Artificial Sequence
  Description of Artificial Sequence: Synthetic polypeptide
  Variable HC Y108L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFALWGQGTLVTVSA

SEQ ID NO: 11733 - protein, 119 aa, Artificial Sequence
  Description of Artificial Sequence: Synthetic polypeptide
  Variable HC Y108C
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFACWGQGTLVTVSA

SEQ ID NO: 11734 - protein, 119 aa, Artificial Sequence
  Description of Artificial Sequence: Synthetic polypeptide
  Variable HC Y108F
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAFWGQGTLVTVSA

SEQ ID NO: 11735 - protein, 119 aa, Artificial Sequence
  Description of Artificial Sequence: Synthetic polypeptide
  Variable HC Y108I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAIWGQGTLVTVSA

SEQ ID NO: 11736 - protein, 119 aa, Artificial Sequence
  Description of Artificial Sequence: Synthetic polypeptide
  Variable HC Y108N
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFANWGQGTLVTVSA

SEQ ID NO: 11737 - protein, 119 aa, Artificial Sequence
  Description of Artificial Sequence: Synthetic polypeptide
  Variable HC Y108S
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFASWGQGTLVTVSA

SEQ ID NO: 11738 - protein, 119 aa, Artificial Sequence
  Description of Artificial Sequence: Synthetic polypeptide
  Variable HC Y108T
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFATWGQGTLVTVSA

SEQ ID NO: 11739 - protein, 119 aa, Artificial Sequence
  Description of Artificial Sequence: Synthetic polypeptide
  Variable HC Y108V
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAVWGQGTLVTVSA

SEQ ID NO: 11740 - protein, 119 aa, Artificial Sequence
  Description of Artificial Sequence: Synthetic polypeptide
  Variable HC Y108W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAWWGQGTLVTVSA

SEQ ID NO: 11741 - protein, 119 aa, Artificial Sequence
  Description of Artificial Sequence: Synthetic polypeptide
  Variable HC W109I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYIGQGTLVTVSA

SEQ ID NO: 11742 - protein, 119 aa, Artificial Sequence
  Description of Artificial Sequence: Synthetic polypeptide
  Variable HC W109M
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYMGQGTLVTVSA

SEQ ID NO: 11743 - protein, 119 aa, Artificial Sequence
  Description of Artificial Sequence: Synthetic polypeptide
  Variable HC W109Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYYGQGTLVTVSA

SEQ ID NO: 11744 - protein, 119 aa, Artificial Sequence
  Description of Artificial Sequence: Synthetic polypeptide
  Variable HC G110R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWRQGTLVTVSA

SEQ ID NO: 11745 - protein, 119 aa, Artificial Sequence
  Description of Artificial Sequence: Synthetic polypeptide
  Variable HC G110A
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWAQGTLVTVSA

SEQ ID NO: 11746 - protein, 119 aa, Artificial Sequence
  Description of Artificial Sequence: Synthetic polypeptide
  Variable HC G110M
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWMQGTLVTVSA

SEQ ID NO: 11747 - protein, 119 aa, Artificial Sequence
  Description of Artificial Sequence: Synthetic polypeptide
  Variable HC G110P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWPQGTLVTVSA

SEQ ID NO: 11748 - protein, 119 aa, Artificial Sequence
  Description of Artificial Sequence: Synthetic polypeptide
  Variable HC G110T
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWTQGTLVTVSA

SEQ ID NO: 11749 - protein, 119 aa, Artificial Sequence
  Description of Artificial Sequence: Synthetic polypeptide
  Variable HC Q111K
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGKGTLVTVSA

SEQ ID NO: 11750 - protein, 119 aa, Artificial Sequence
  Description of Artificial Sequence: Synthetic polypeptide
  Variable HC Q111H
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGHGTLVTVSA

SEQ ID NO: 11751 - protein, 119 aa, Artificial Sequence
  Description of Artificial Sequence: Synthetic polypeptide
  Variable HC Q111R
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGRGTLVTVSA

SEQ ID NO: 11752 - protein, 119 aa, Artificial Sequence
  Description of Artificial Sequence: Synthetic polypeptide
  Variable HC Q111L
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGLGTLVTVSA

SEQ ID NO: 11753 - protein, 119 aa, Artificial Sequence
  Description of Artificial Sequence: Synthetic polypeptide
  Variable HC Q111D
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGDGTLVTVSA

SEQ ID NO: 11754 - protein, 119 aa, Artificial Sequence
  Description of Artificial Sequence: Synthetic polypeptide
  Variable HC Q111E
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGEGTLVTVSA

SEQ ID NO: 11755 - protein, 119 aa, Artificial Sequence
  Description of Artificial Sequence: Synthetic polypeptide
  Variable HC Q111G
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGGGTLVTVSA

SEQ ID NO: 11756 - protein, 119 aa, Artificial Sequence
  Description of Artificial Sequence: Synthetic polypeptide
  Variable HC Q111M
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGMGTLVTVSA

SEQ ID NO: 11757 - protein, 119 aa, Artificial Sequence
  Description of Artificial Sequence: Synthetic polypeptide
  Variable HC Q111P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGPGTLVTVSA

SEQ ID NO: 11758 - protein, 119 aa, Artificial Sequence
  Description of Artificial Sequence: Synthetic polypeptide
  Variable HC Q111S
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGSGTLVTVSA

SEQ ID NO: 11759 - protein, 119 aa, Artificial Sequence
  Description of Artificial Sequence: Synthetic polypeptide
  Variable HC Q111T
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGTGTLVTVSA

SEQ ID NO: 11760 - protein, 119 aa, Artificial Sequence
  Description of Artificial Sequence: Synthetic polypeptide
  Variable HC Q111W
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGWGTLVTVSA

SEQ ID NO: 11761 - protein, 119 aa, Artificial Sequence
  Description of Artificial Sequence: Synthetic polypeptide
  Variable HC Q111Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGYGTLVTVSA

SEQ ID NO: 11762 - protein, 119 aa, Artificial Sequence
  Description of Artificial Sequence: Synthetic polypeptide
  Variable HC G112A
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQATLVTVSA

SEQ ID NO: 11763 - protein, 119 aa, Artificial Sequence
  Description of Artificial Sequence: Synthetic polypeptide
  Variable HC G112N
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQNTLVTVSA

SEQ ID NO: 11764 - protein, 119 aa, Artificial Sequence
  Description of Artificial Sequence: Synthetic polypeptide
  Variable HC G112P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQPTLVTVSA

SEQ ID NO: 11765 - protein, 119 aa, Artificial Sequence
  Description of Artificial Sequence: Synthetic polypeptide
  Variable HC G112S
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQSTLVTVSA

SEQ ID NO: 11766 - protein, 119 aa, Artificial Sequence
  Description of Artificial Sequence: Synthetic polypeptide
  Variable HC G112T
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQTTLVTVSA

SEQ ID NO: 11767 - protein, 119 aa, Artificial Sequence
  Description of Artificial Sequence: Synthetic polypeptide
  Variable HC G112Y
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQYTLVTVSA

SEQ ID NO: 11768 - protein, 119 aa, Artificial Sequence
  Description of Artificial Sequence: Synthetic polypeptide
  Variable LC Y104D/Q111P
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 11769 - protein, 119 aa, Artificial Sequence
  Description of Artificial Sequence: Synthetic polypeptide
  Variable LC V24E
QVQLKQSGPGLVQPSQSLSITCTESGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11770 - protein, 119 aa, Artificial Sequence
  Description of Artificial Sequence: Synthetic polypeptide
  Variable LC Q111V
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGVGTLVTVSA

SEQ ID NO: 11771 - protein, 330 aa, Artificial Sequence [sequence omitted]

SEQ ID NO: 11772 - protein, 119 aa, Artificial Sequence
  Description of Artificial Sequence: Synthetic polypeptide
  Variable HC V24E/F27R/R97H/Q111P
QVQLKQSGPGLVQPSQSLSITCTESGRSLTNYGVHWVRQSPGKGLEWLGVIWSGGNTDYNTPFTSRLSINKDNSKSQVFFKMNSLQSNDTAIYYCAHALTYYDYEFAYWGPGTLVTVSA

SEQ ID NO: 11773 - protein, 119 aa, Artificial Sequence
  Description of Artificial Sequence: Synthetic polypeptide
  Variable HC S28C
QVQLKQSGPGLVQPSQSLSITCTVSGFCLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11774 - protein, 119 aa, Artificial Sequence
  Description of Artificial Sequence: Synthetic polypeptide
  Variable HC F63P
QVQLKQSGPGLVQPSQSLSITCTVSGFSLTNYGVHWVRQSPGKGLEWLGVIWSGGNTDYNTPPTSRLSINKDNSKSQVFFKMNSLQSNDTAIYYCARALTYYDYEFAYWGQGTLVTVSA

SEQ ID NO: 11775 - protein, 119 aa, Artificial Sequence
  Description of Artificial Sequence: Synthetic polypeptide
  Variable HC L67G
QVQLKQSGPGLVQPSQSLSITCTVSGFSLTNYGVHWVRQSPGKGLEWLGVIWSGGNTDYNTPFTSRGSINKDNSKSQVFFKMNSLQSNDTAIYYCARALTYYDYEFAYWGQGTLVTVSA

SEQ ID NO: 11776 - protein, 119 aa, Artificial Sequence
  Description of Artificial Sequence: Synthetic polypeptide
  Variable HC D72P
QVQLKQSGPGLVQPSQSLSITCTVSGFSLTNYGVHWVRQSPGKGLEWLGVIWSGGNTDYNTPFTSRLSINKPNSKSQVFFKMNSLQSNDTAIYYCARALTYYDYEFAYWGQGTLVTVSA

SEQ ID NO: 11777 - protein, 119 aa, Artificial Sequence
  Description of Artificial Sequence: Synthetic polypeptide
  Variable HC K75G
QVQLKQSGPGLVQPSQSLSITCTVSGFSLTNYGVHWVRQSPGKGLEWLGVIWSGGNTDYNTPFTSRLSINKDNSGSQVFFKMNSLQSNDTAIYYCARALTYYDYEFAYWGQGTLVTVSA

SEQ ID NO: 11778 - protein, 119 aa, Artificial Sequence
  Description of Artificial Sequence: Synthetic polypeptide
  Variable HC K75P
QVQLKQSGPGLVQPSQSLSITCTVSGFSLTNYGVHWVRQSPGKGLEWLGVIWSGGNTDYNTPFTSRLSINKDNSPSQVFFKMNSLQSNDTAIYYCARALTYYDYEFAYWGQGTLVTVSA

SEQ ID NO: 11779 - protein, 119 aa, Artificial Sequence
  Description of Artificial Sequence: Synthetic polypeptide
  Variable HC S76I
QVQLKQSGPGLVQPSQSLSITCTVSGFSLTNYGVHWVRQSPGKGLEWLGVIWSGGNTDYNTPFTSRLSINKDNSKIQVFFKMNSLQSNDTAIYYCARALTYYDYEFAYWGQGTLVTVSA

SEQ ID NO: 11780 - protein, 119 aa, Artificial Sequence
  Description of Artificial Sequence: Synthetic polypeptide
  Variable HC S76V
QVQLKQSGPGLVQPSQSLSITCTVSGFSLTNYGVHWVRQSPGKGLEWLGVIWSGGNTDYNTPFTSRLSINKDNSKVQVFFKMNSLQSNDTAIYYCARALTYYDYEFAYWGQGTLVTVSA

SEQ ID NO: 11781 - protein, 119 aa, Artificial Sequence
  Description of Artificial Sequence: Synthetic polypeptide
  Variable HC Q111I
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGIGTLVTVSA

SEQ ID NO: 11782 - protein, 119 aa, Artificial Sequence
  Description of Artificial Sequence: Synthetic polypeptide
  Variable HC S25C/Y104D
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDYEFAYWGPGTLVTVSA

SEQ ID NO: 11783 - protein, 119 aa, Artificial Sequence
  Description of Artificial Sequence: Synthetic polypeptide
  Variable HC S25C/Q111P
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 11784 - protein, 119 aa, Artificial Sequence
  Description of Artificial Sequence: Synthetic polypeptide
  Variable HC S53G/Y104D
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 11785 - protein, 119 aa, Artificial Sequence
  Description of Artificial Sequence: Synthetic polypeptide
  Variable HC S25V/Y104D
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 11786 - protein, 119 aa, Artificial Sequence
  Description of Artificial Sequence: Synthetic polypeptide
  Variable HC S25V/Y104D/Q111P
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 11787 - protein, 119 aa, Artificial Sequence
  Description of Artificial Sequence: Synthetic polypeptide
  Variable HC S25V/S53G/Y104D
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 11788 - protein, 119 aa, Artificial Sequence
  Description of Artificial Sequence: Synthetic polypeptide
  Variable HC S25V/S53G/Y104D/Q111P
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 11789 - protein, 119 aa, Artificial Sequence
  Description of Artificial Sequence: Synthetic polypeptide
  Variable HC F27G/Y104D
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 11790 - protein, 119 aa, Artificial Sequence
  Description of Artificial Sequence: Synthetic polypeptide
  Variable HC F27G/Y104D/Q111P
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 11791 - protein, 119 aa, Artificial Sequence
  Description of Artificial Sequence: Synthetic polypeptide
  Variable HC F27G/S53G/Y104D
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 11792 - protein, 119 aa, Artificial Sequence
  Description of Artificial Sequence: Synthetic polypeptide
  Variable HC F27G/S53G/Y104D/Q111P
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 11793 - protein, 119 aa, Artificial Sequence
  Description of Artificial Sequence: Synthetic polypeptide
  Variable HC T30F/Y104D
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDDEFAYWGQGTLVTVSA

SEQ ID NO: 11794 - protein, 119 aa, Artificial Sequence
  Description of Artificial Sequence: Synthetic polypeptide
  Variable HC T30F/Y104D/Q111P
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDDEFAYWGPGTLVTVSA

SEQ ID NO: 11795 - protein, 119 aa, Artificial Sequence
  Description of Artificial Sequence: Synthetic polypeptide
  Variable HC T30F/S53G/Y104D
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDDEFAYWGQGTLVTVSA

SEQ ID NO: 11796 - protein, 119 aa, Artificial Sequence
  Description of Artificial Sequence: Synthetic polypeptide
  Variable HC T30F/S53G/Y104D/Q111P
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDDEFAYWGPGTLVTVSA

SEQ ID NO: 11797 - protein, 119 aa, Artificial Sequence
  Description of Artificial Sequence: Synthetic polypeptide
  Variable HC D72L/Y104D
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDDEFAYWGQGTLVTVSA

SEQ ID NO: 11798 - protein, 119 aa, Artificial Sequence
  Description of Artificial Sequence: Synthetic polypeptide
  Variable HC D72L/Y104D/Q111P
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDDEFAYWGPGTLVTVSA

SEQ ID NO: 11799 - protein, 119 aa, Artificial Sequence
  Description of Artificial Sequence: Synthetic polypeptide
  Variable HC S53G/D72L/Y104D
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDDEFAYWGQGTLVTVSA

SEQ ID NO: 11800 - protein, 119 aa, Artificial Sequence
  Description of Artificial Sequence: Synthetic polypeptide
  Variable HC S53G/D72L/Y104D/Q111P
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDDEFAYWGPGTLVTVSA

SEQ ID NO: 11801 - protein, 107 aa, Homo sapiens
  MOD_RES (53)..(53): Glu or an amino acid having a side chain that is either nonpolar and/or is neutral or positive in charge and/or may not be small
  MOD_RES (94)..(94): Trp or an amino acid having a side chain that is either polar and/or is charge positive or negative and/or is not bulky
DILLTQSPVILSVSPGERVSFSCRASQSIGTNIHWYQQRTNGSPRLLIKYASXSISGIPSRFSGSGSGTDFTLSINSVESEDIADYYCQQNNNXPTTFGAGTKLELK

SEQ ID NO: 11802 - protein, 120 aa, Homo sapiens
QVTLRESGPTLVKPTQTLTLTCTFSGFSLTSLSESVAWIRQSPGKALEWLALIYWDDDKLYSPSLKSRLTITKDTSKNEVVLTMTNVDSADTATYFCAHKKIRDTGFDFWGQGTLVTVSS

SEQ ID NO: 11803 - protein, 128 aa, Homo sapiens
EVQLVQSGAEVKKPGASVKVSCKASGGTFSSYAISWVRQAPGQGLEWMGGIIPILGTADYAQKFQGRVTITADESTSTAYMELSSLRSEDTAVYYCARDEIPLEYCTSTSCYHAFDIWGQGTMVTVSS

SEQ ID NO: 11804 - protein, 128 aa, Homo sapiens
QVQLVQSGAEVKKPGSSVKVSCKASGGTFRNHAFSWVRQAPGQGLEWMGWISAYNGYTHYAEKLQGRVTMTTDTSTSTAYMELRSLRSDDTAVYYCARVSASYNSDWSLHYYYGMDVWGQGTTVTVSS

SEQ ID NO: 11805 - protein, 127 aa, Homo sapiens
QVQLVQSGAEVKKPGASVKVSCKASGYTFIRNDINWVRQASGQGLEWIGWMNPNTGATASAQNFQGRVAMTRNASMNTAYLELSGLRSDDTAIYYCARAFEDYIWESSEFHFGLDVWGQGTTVTVSS

SEQ ID NO: 11806 - protein, 120 aa, Homo sapiens
QVQLVQSGGGVVQPGRSLRLSCAASGFIFNHYAMHWVRQAPGKGLEWVAHISSDGSYKFYADSVKGRFTVSRDNSDNTVYLQMNSLGPEDTAVYHCARFTEVLYYGADYWGQGTLVTVSS

SEQ ID NO: 11807 - protein, 128 aa, Homo sapiens
QVQLVQSGAEVKKPGSAVKVSCKASGGTFSSYAISWVRQAPGQGLEWMGGIIPILGTADYAQKFQGRVTITADESTSTAYMELSSLRSEDTAVYYCARDEIPLEYCTSTSCYHAFDIWGQGTMVTVSS

SEQ ID NO: 11808 - protein, 119 aa, Homo sapiens
QMQLVQSWAEVKKPGASVKVSCKASAYTFTNYYIHWVRQAPGQGLEWMGIINPSSGATTYAQRLQGRVIMTRDTSTSTVNMELSSLRSEDTAVYYCARSTLWFSEFDYWGQGTLVTVSS

SEQ ID NO: 11809 - protein, 120 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARRYYDSSLSFDYWGQGTLVTVSS

SEQ ID NO: 11810 - protein, 121 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDGGNWNYGGGDYWGQGTLVTVSS

SEQ ID NO: 11811 - protein, 120 aa, Homo sapiens
EVQLVESGGGVVQPGRSLRLSCAASGFIFNHYAMHWVRQAPGKGLEWVAHISSDGSYKFYADSVKGRFTVSRDNSDNTVYLQMNSLGPEDTAVYHCARFTEVLYYGADYWGQGTLVTVSS

SEQ ID NO: 11812 - protein, 124 aa, Homo sapiens
QVQLQQSGAEVKKPGASVKVSCKASGYTFTDHGIIWVRQAPGQGLEWMGWINTDNGNTIYAPKFQGRVTMTTDTSTSIVYMELQSLRSDDTAVYFCSREDWNYDGGLREVFDYWGQGTLVTVSS

SEQ ID NO: 11813 - protein, 128 aa, Homo sapiens
EVQLVQSGAEVKKPGSAVKVSCKASGGTFSSYAISWVRQAPGQGLEWMGGIIPILGTADYAQKFQGRVTITADESTSTAYMELSSLRSEDTAVYYCARDEIPLEYCTSTSCYHAFDIWGRGTMVTVSS

SEQ ID NO: 11814 - protein, 118 aa, Homo sapiens
QVQLVESGGGLVQPGGSLRLFCAASGFGVSTNYMSWVRQAPGKGLEWVSVIYSGGATYYADSVKGRFTISRDNSKNTLYLQMNSLRPEDTAVYYCAKESPNDDYFDYWGQGTLVTVSS

SEQ ID NO: 11815 - protein, 128 aa, Homo sapiens
QVQLVQSGAEVKKPGSSVKVSCKASGGTFSSYAISWVRQAPGQGLEWMGGIIPIFGTASYAQKFQGRVTITADESTTTAYMELSSLRSEDTAVYYCAREGPEYCSGGTCYSADAFDIWGQGTMVTVSS

SEQ ID NO: 11816 - protein, 120 aa, Homo sapiens
QVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREAPIAADAFDIWGQGTMVTVSS

SEQ ID NO: 11817 - protein, 117 aa, Homo sapiens
EVQLVQSGAEVKKPGSSVKVSCKASGGTFSSYPISWVRQAPGQGLEWMGGIIPIFGIANYAQKFQGRVTITADESTSTAYMELSSLRSEDTAVYYCARDSSGYSLYWGQGTLVTVSS

SEQ ID NO: 11818 - protein, 119 aa, Homo sapiens
QVQLVQSGAEVKKPGESLRISCKGSGYSFTSYWISWVRQMPGKGLEWMGWIDPSDSYTNYSPSFQGHVTISADKSISTAYLQWSSLKASDTAVYYCAIQTSSSDAFDIWGQGTMVTVSS

SEQ ID NO: 11819 - protein, 121 aa, Homo sapiens
QVQLQQSGPGLVKPSQTLSLTCAISGDSVASNGASWNWIRQSPSRGLEWLSKTYYRSKWYYEYAPSVTSRMTISPDTSKNQFSLQVTSVTPEDTAVYYCARLIGDGLIDYWGQGTLVTVSS

SEQ ID NO: 11820 - protein, 122 aa, Homo sapiens
EVQLVESGGGLVKPGGSLRLSCVGSGVDTNSRAISWVRQAPGKGLEWVSVIYSGGGGTNYADSVKGRFTISRDKSRNTVFLQMNSLRVEDTALYYCAKDPGWPIAGWYFDLWGRGTLVTVSS

SEQ ID NO: 11821 - protein, 125 aa, Homo sapiens
QVQLQQSGPGLVQPSQTLSLTCAISGDTVSTNYHAWNWIRQSPSRGLEWLGRTYYRSKWYNDYAVSVKSRVTISPDTSKNHFSLQLKSVTPEDTAVYYCARDGGTTNYYNVFDVWGQGTTVTVSS

SEQ ID NO: 11822 - protein, 119 aa, Homo sapiens
EVQLVQSGAEVKKPGASVKVSCKASGYTFTGYYMHWVRQAPGQGLEWLGWINPSSGFTDYAHKFQGRVTMTRDTSTSTVYMELSSLRSEDTAVYYCARSTLWFSEFDYWGQGTLVTVSS

SEQ ID NO: 11823 - protein, 120 aa, Homo sapiens
QVQLVESGAEVKKPGASVKVSCKASGYTFTDYHIHWVRQAPGQGLEWMGWINTYNGNTQYAQHVQDRVTMTRDSATSSVYLELRSLRSDDTALYFCALPNDYYSYAMDVWGQGTTVTVSS

SEQ ID NO: 11824 - protein, 123 aa, Homo sapiens
EVQLVESGAEVKKPGASVKVSCKASGYTFTSYYMHWVRQAPGQGLEWMGIINPNDGSTTYAQNFQGRITMTRDTSTRTAYMELSSLRSEDTAVYYCARVDSSLGGYYYGMDVWGQGTTVTVSS

SEQ ID NO: 11825 - protein, 118 aa, Homo sapiens
QVQLQQWAEVKKPGASVKVSCKASGYTFTDHYIDWVRQAPGQGLEWMGRINPNSGYTNYAQTFQGRVTMTRDTSINTAYMDLSSLRSEDTAVYYCARSTLWFSEFDYWGQGTLVTVSS

SEQ ID NO: 11826 - protein, 125 aa, Homo sapiens
EVQLLESGGGVVQPGRSLRLSCAASGFTFSSYAIHWVRQAPGKGLEWVAVISFDGNNKYYADSMKGRFTISRDNAKNSLYLQMNSLRAEDTAVYYCARDQYYDILTGYYYGMDVWGQGTTVTVSS

SEQ ID NO: 11827 - protein, 122 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARHGSYYDPYYGMDVWGQGTTVTVSS

SEQ ID NO: 11828 - protein, 118 aa, Homo sapiens
VQLVQSGAEVKNPGASVKVSCKASGFTFTSYDLNWVRQAPGQGLEWMGWMNPINGNTGYAQKFQGRVSMTRDTSTSTVYMELSSLRSEDTAVYYCARADLWFGELDYWGQGTLVTVSS

SEQ ID NO: 11829 - protein, 127 aa, Homo sapiens
QVQLVQSGAEVKKPGSSVKVSCKASGGTFRNHAWSWVRQAPGQGLEWMGWISAYNGYTHYASKLQGRVTMTTDTSTSTAYMELRSLRSDDTAVYYCARVSAEYAEDWSLHYYYMDVWGQGTLVTVSS

SEQ ID NO: 11830 - protein, 128 aa, Homo sapiens
QVQLVQSGAEVKKPGSSVKVSCKASGGTFRNHAWSWVRQAPGQGLEWMGWISAYNGYTTYASKLQGRVTMTTDTSTSTAYMELRSLRSDDTAVYYCARVSASYNEDWSLHYYYGMDVWGQGTLVTVSS

SEQ ID NO: 11831 - protein, 128 aa, Homo sapiens
QVQLVQSGAEVKKPGSSVKVSCKASGGTFRNHAYSWVRQAPGQGLEWMGWISAYNGYTTYASKLQGRVTMTTDTSTSTAYMELRSLRSDDTAVYYCARVSASYNSDWSLHYYYGMDVWGQGTLVTVSS

SEQ ID NO: 11832 - protein, 128 aa, Homo sapiens
QVQLVQSGAEVKKPGSSVKVSCKASGGTFRNHAYSWVRQAPGQGLEWMGWISAYNGYTHYASKLQGRVTMTTDTSTSTAYMELRSLRSDDTAVYYCARVSASYASDWSLHYYYGMDVWGQGTLVTVSS

SEQ ID NO: 11833 - protein, 128 aa, Homo sapiens
QVQLVQSGAEVKKPGSSVKVSCKASGGTFRNHAYSWVRQAPGQGLEWMGWISAYNGYTTYASKLQGRVTMTTDTSTSTAYMELRSLRSDDTAVYYCARVSAEYNSDWSLHYYYGMDVWGQGTLVTVSS

SEQ ID NO: 11834 - protein, 128 aa, Homo sapiens
QVQLVQSGAEVKKPGSSVKVSCKASGGTFRNHAYSWVRQAPGQGLEWMGWISAYNGYTHYAEKLQGRVTMTTDTSTSTAYMELRSLRSDDTAVYYCARVSAEYNSDWSVHYYYGMDVWGQGTLVTVSS

SEQ ID NO: 11835 - protein, 128 aa, Homo sapiens
QVQLVQSGAEVKKPGSSVKVSCKASGGTFRNHAYSWVRQAPGQGLEWMGWISAYNGYTTYAEKLQGRVTMTTDTSTSTAYMELRSLRSDDTAVYYCARVSAEYAEDWSLHYYYGMDVWGQGTLVTVSS

SEQ ID NO: 11836 - protein, 120 aa, Homo sapiens
EVQLVESGGGVVQPGRSLRLSCAASGFIFHHYAMHWVRQAPGKGLEWVAHISIDGSSKFYADSVKGRFTVSRDNSKNTLYLQMNSLRAEDTAVYYCARFTEVLYYGADLWGQGTLVTVSS

SEQ ID NO: 11837 - protein, 128 aa, Homo sapiens
QVQLVQSGAEVKKPGSSVKVSCKASGGTFRNHAYSWVRQAPGQGLEWMGWISAYNGYTTYAEKLQGRVTMTTDTSTSTAYMELRSLRSDDTAVYYCARVSAEYNSDWSVHYYYGMDVWGQGTLVTVSS

SEQ ID NO: 11838 - protein, 128 aa, Homo sapiens
QVQLVQSGAEVKKPGSSVKVSCKASGGTFRNHAWSWVRQAPGQGLEWMGWISAYNGYTTYASKLQGRVTMTTDTSTSTAYMELRSLRSDDTAVYYCARVSAEYASDWSLHYYYGMDVWGQGTLVTVSS

SEQ ID NO: 11839 - protein, 128 aa, Homo sapiens
QVQLVQSGAEVKKPGSSVKVSCKASGGTFRNHAWSWVRQAPGQGLEWMGWISAYNGYTTYAEKLQGRVTMTTDTSTSTAYMELRSLRSDDTAVYYCARVSAEYAEDWSLHYYYGMDVWGQGTLVTVSS

SEQ ID NO: 11840 - protein, 128 aa, Homo sapiens
QVQLVQSGAEVKKPGSSVKVSCKASGGTFRNHAWSWVRQAPGQGLEWMGWISAYNGYTTYASKLQGRVTMTTDTSTSTAYMELRSLRSDDTAVYYCARVSASYASDWSVHYYYGMDVWGQGTLVTVSS

SEQ ID NO: 11841 - protein, 128 aa, Homo sapiens
QVQLVQSGAEVKKPGSSVKVSCKASGGTFRNHAWSWVRQAPGQGLEWMGWISAYNGYTTYASKLQGRVTMTTDTSTSTAYMELRSLRSDDTAVYYCARVSASYNSDWSVHYYYGMDVWGQGTLVTVSS

SEQ ID NO: 11842 - protein, 128 aa, Homo sapiens
QVQLVQSGAEVKKPGSSVKVSCKASGGTFRNHAWSWVRQAPGQGLEWMGWISAYNGYTTYAEKLQGRVTMTTDTSTSTAYMELRSLRSDDTAVYYCARVSASYASDWSLHYYYGMDVWGQGTLVTVSS

SEQ ID NO: 11843 - protein, 128 aa, Homo sapiens
QVQLVQSGAEVKKPGSSVKVSCKASGGTFRNHAYSWVRQAPGQGLEWMGWISAYNGYTTYASKLQGRVTMTTDTSTSTAYMELRSLRSDDTAVYYCARVSASYNEDWSLHYYYGMDVWGQGTLVTVSS

SEQ ID NO: 11844 - protein, 128 aa, Homo sapiens
QVQLVQSGAEVKKPGSSVKVSCKASGGTFRNHAYSWVRQAPGQGLEWMGWISAYNGYTTYASKLQGRVTMTTDTSTSTAYMELRSLRSDDTAVYYCARVSASYNSDWSVHYYYGMDVWGQGTLVTVSS

SEQ ID NO: 11845 - protein, 128 aa, Homo sapiens
QVQLVQSGAEVKKPGSSVKVSCKASGGTFRNHAYSWVRQAPGQGLEWMGWISAYNGYTTYAEKLQGRVTMTTDTSTSTAYMELRSLRSDDTAVYYCARVSAEYASDWSLHYYYGMDVWGQGTLVTVSS

SEQ ID NO: 11846 - protein, 120 aa, Homo sapiens
EVQLVESGGGVVQPGRSLRLSCAASGFIFHHYAMHWVRQAPGKGLEWVAHISPDGSSKFYADSVKGRFTVSRDNSKNTLYLQMNSLRAEDTAVYYCARFTEVLYYGADIWGQGTLVTVSS

SEQ ID NO: 11847 - protein, 120 aa, Homo sapiens
EVQLVESGGGVVQPGRSLRLSCAASGFIFHHYAMHWVRQAPGKGLEWVAHISLDGSYKFYADSVKGRFTVSRDNSKNTLYLQMNSLRAEDTAVYYCARFTEVLYYGADIWGQGTLVTVSS

SEQ ID NO: 11848 - protein, 120 aa, Homo sapiens
EVQLVESGGGVVQPGRSLRLSCAASGFIFHHYAMHWVRQAPGKGLEWVAHISPDGSSKFYADSVKGRFTVSRDNSKNTLYLQMNSLRAEDTAVYYCARFTEVLYYGADYWGQGTLVTVSS

SEQ ID NO: 11849 - protein, 120 aa, Homo sapiens
EVQLVESGGGVVQPGRSLRLSCAASGFIFHHYAMHWVRQAPGKGLEWVAHISPDGSYKFYADSVKGRFTVSRDNSKNTLYLQMNSLRAEDTAVYYCARFTEVLYYGADLWGQGTLVTVSS

SEQ ID NO: 11850 - protein, 120 aa, Homo sapiens
EVQLVESGGGVVQPGRSLRLSCAASGFIFHHYAMHWVRQAPGKGLEWVAHISSDGSSKFYADSVKGRFTVSRDNSKNTLYLQMNSLRAEDTAVYYCARFTEVLYYGADLWGQGTLVTVSS

SEQ ID NO: 11851 - protein, 120 aa, Homo sapiens
EVQLVESGGGVVQPGRSLRLSCAASGFIFHHYAMHWVRQAPGKGLEWVAHISSDGSYKFYADSVKGRFTVSRDNSKNTLYLQMNSLRAEDTAVYYCARFTEVLYYGADLWGQGTLVTVSS

SEQ ID NO: 11852 - protein, 120 aa, Homo sapiens
EVQLVESGGGVVQPGRSLRLSCAASGFIFHHYAMHWVRQAPGKGLEWVAHISPDGSYKFYADSVKGRFTVSRDNSKNTLYLQMNSLRAEDTAVYYCARFTEVLYYGADIWGQGTLVTVSS

SEQ ID NO: 11853 - protein, 120 aa, Homo sapiens
EVQLVESGGGVVQPGRSLRLSCAASGFIFHHYAMHWVRQAPGKGLEWVAHISPDGSSKFYADSVKGRFTVSRDNSKNTLYLQMNSLRAEDTAVYYCARFTEVLYYGADLWGQGTLVTVSS

SEQ ID NO: 11854 - protein, 120 aa, Homo sapiens
EVQLVESGGGVVQPGRSLRLSCAASGFIFHHYSMHWVRQAPGKGLEWVAHISSDGSSKFYADSVKGRFTVSRDNSKNTLYLQMNSLRAEDTAVYYCARFTEVLYYGADLWGQGTLVTVSS

SEQ ID NO: 11855 - protein, 120 aa, Homo sapiens
EVQLVESGGGVVQPGRSLRLSCAASGFTFSHYAMHWVRQAPGKGLEWVAHISLDGSSKFYADSVKGRFTVSRDNSKNTLYLQMNSLRAEDTAVYYCARFTEVLYYGADLWGQGTLVTVSS

SEQ ID NO: 11856 - protein, 117 aa, Artificial Sequence
  Description of Artificial Sequence: Synthetic polypeptide
  antibody variable region sequence
EVQLVESGGGLVQPGGSLRLSCAASGFTFSSYWMTWVRQAPGKGLEWVANIQQDGSEKNYLDSVKGRFTISRDNAKNSLSLQMNSLRAEDTAVYYCARTYSGFEDFWGQGTLVTVSS

SEQ ID NO: 11857 - protein, 117 aa, Artificial Sequence
  Description of Artificial Sequence: Synthetic polypeptide
  antibody variable region sequence
EVQLVESGGGLVQPGGSLRLSCAASRFTFSDYWMTWVRQAPGKGLEWVAHIKQDGSEKYYVDSVKGRFTISRDNAKNSLYLQMNSLRAEDTALYYCARGFLIYFDYWGQGTLVTVSS

SEQ ID NO: 11858 - protein, 121 aa, Artificial Sequence
  Description of Artificial Sequence: Synthetic polypeptide
  antibody variable region sequence
EVQLVESGGGLVQPGGSLRLSCAASGFTFSSYWMNWVRQAPGKGLEWVANIKKDGSEKYYVDSVKGRFTISRDNAKNSLYLQMNSLRAEDTAVYYCARDLGWGWGWYFDLWGRGTLVTVSS

SEQ ID NO: 11859 - protein, 120 aa, Artificial Sequence
  Description of Artificial Sequence: Synthetic polypeptide
  Synthetic (heavy-chain variable region of anti-EGFR antibody (modified))
QVQLVQSGAEVKKPGSSVKVSCKASGFTFTDYKIHWVRQAPGQCLEWMGYINPNSGYSTYASKFQGRVTITADKSTSTAYMELSSLRSEDTAVYYCARLSPGGYYVMDAWGQGTTVTVSS

SEQ ID NO: 11860 - protein, 119 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 11861 - protein, 119 aa, Artificial Sequence
  Description of Artificial Sequence: Synthetic polypeptide
  Cetuximab S119 heavy chain variable domain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSS

SEQ ID NO: 11862 - protein, 119 aa, Artificial Sequence
  Description of Artificial Sequence: Synthetic polypeptide
  Humanized Cetuximab (H225) heavy chain variable domain
EVQLVESGGGLVQPGGSLRLSCAVSGFSLTNYGVHWVRQATGKGLEWLGVIWSGGNTDYNTPFTSRLTISKENAKNSLYLQMNSLRAGDTAVYYCARALTYYDYEFAYWGQGTMVTVSS

SEQ ID NO: 11863 - protein, 119 aa, Artificial Sequence
  Description of Artificial Sequence: Synthetic polypeptide
  E-h3, 7 heavy chain variable domain amino acid S119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGQGTLVTVSS

SEQ ID NO: 11864 - protein, 119 aa, Artificial Sequence
  Description of Artificial Sequence: Synthetic polypeptide
  E-h3, 7 heavy chain variable domain amino acid A119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGQGTLVTVSA

SEQ ID NO: 11865 - protein, 119 aa, Artificial Sequence
  Description of Artificial Sequence: Synthetic polypeptide
  HC-Y104D control heavy chain variable domain amino acid S119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDDEFAYWGQGTLVTVSS

SEQ ID NO: 11866 - protein, 119 aa, Artificial Sequence
  Description of Artificial Sequence: Synthetic polypeptide
  HC-Y104E heavy chain variable domain amino acid S119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 11867 - protein, 119 aa, Artificial Sequence
  Description of Artificial Sequence: Synthetic polypeptide
  HC-Y104E heavy chain variable domain amino acid A119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 11868 - protein, 118 aa, Artificial Sequence
  Description of Artificial Sequence: Synthetic polypeptide
  HC-Y104E/HC-Q111P heavy chain variable domain amino acid S119
VQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 11869 - protein, 119 aa, Artificial Sequence
  Description of Artificial Sequence: Synthetic polypeptide
  HC-Y104E/HC-Q111P heavy chain variable domain amino acid A119
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 11870 - protein, 119 aa, Artificial Sequence
  Description of Artificial Sequence: Synthetic polypeptide
  HC-S25C/HC-Y104E heavy chain variable domain amino acid S119
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 11871 - protein, 119 aa, Artificial Sequence
  Description of Artificial Sequence: Synthetic polypeptide
  HC-S25C/HC-Y104E heavy chain variable domain amino acid A119
QVQLKQSGPGLVQPSQSLSITCTVCGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 11872 - protein, 119 aa, Artificial Sequence
  Description of Artificial Sequence: Synthetic polypeptide
  HC-S53G/HC-Y104E heavy chain variable domain amino acid S119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 11873 - protein, 119 aa, Artificial Sequence
  Description of Artificial Sequence: Synthetic polypeptide
  HC-S53G/HC-Y104E heavy chain variable domain amino acid A119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 11874 - protein, 119 aa, Artificial Sequence
  Description of Artificial Sequence: Synthetic polypeptide
  HC-S53G/HC-Y104E/HC-Q111P heavy chain variable domain amino acid S119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSS

SEQ ID NO: 11875 - protein, 119 aa, Artificial Sequence
  Description of Artificial Sequence: Synthetic polypeptide
  HC-S53G/HC-Y104E/HC-Q111P heavy chain variable domain amino acid A119
QVQLKQSGPGLVQPSQSLSITCTVSGFSLTNYGVHWVRQSPGKGLEWLGVIWGGGNTDYNTPFTSRLSINKDNSKSQVFFKMNSLQSNDTAIYYCARALTYYDEEFAYWGPGTLVTVSA

SEQ ID NO: 11876 - protein, 119 aa, Artificial Sequence
  Description of Artificial Sequence: Synthetic polypeptide
  HC-S25V/HC-Y104E heavy chain variable domain amino acid S119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 11877 - protein, 119 aa, Artificial Sequence
  Description of Artificial Sequence: Synthetic polypeptide
  HC-S25V/HC-Y104E heavy chain variable domain amino acid A119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 11878 - protein, 119 aa, Artificial Sequence
  Description of Artificial Sequence: Synthetic polypeptide
  HC-S25V/HC-Y104E/HC-Q111P heavy chain variable domain amino acid S119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 11879 - protein, 119 aa, Artificial Sequence
  Description of Artificial Sequence: Synthetic polypeptide
  HC-S25V/HC-Y104E/HC-Q111P heavy chain variable domain amino acid A119
QVQLKQSGPGLVQPSQSLSITCTVVGFSLTNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 11880 - protein, 119 aa, Artificial Sequence
  Description of Artificial Sequence: Synthetic polypeptide
  HC-S25V/HC-S53G/HC-Y104E heavy chain variable domain amino acid S119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 11881 - protein, 119 aa, Artificial Sequence
  Description of Artificial Sequence: Synthetic polypeptide
  HC-S25V/HC-S53G/HC-Y104E heavy chain variable domain amino acid A119
QVQLKQSGPGLVQPSQSLSITCTVVGFSLTNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 11882 - protein, 119 aa, Artificial Sequence
  Description of Artificial Sequence: Synthetic polypeptide
  HC-T30F/HC-Y104E heavy chain variable domain amino acid S119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 11883 - protein, 119 aa, Artificial Sequence
  Description of Artificial Sequence: Synthetic polypeptide
  HC-T30F/HC-Y104E heavy chain variable domain amino acid A119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 11884 - protein, 119 aa, Artificial Sequence
  Description of Artificial Sequence: Synthetic polypeptide
  HC-T30F/HC-Y104E/HC-Q111P heavy chain variable domain amino acid S119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 11885 - protein, 119 aa, Artificial Sequence
  Description of Artificial Sequence: Synthetic polypeptide
  HC-T30F/HC-Y104E/HC-Q111P heavy chain variable domain amino acid A119
QVQLKQSGPGLVQPSQSLSITCTVSGFSLFNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 11886 - protein, 119 aa, Artificial Sequence
  Description of Artificial Sequence: Synthetic polypeptide
  HC-T30F/HC-S53G/HC-Y104E heavy chain variable domain amino acid S119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 11887 - protein, 119 aa, Artificial Sequence
  Description of Artificial Sequence: Synthetic polypeptide
  HC-T30F/HC-S53G/HC-Y104E heavy chain variable domain amino acid A119
QVQLKQSGPGLVQPSQSLSITCTVSGFSLFNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 11888 - protein, 119 aa, Artificial Sequence
  Description of Artificial Sequence: Synthetic polypeptide
  HC-D72L/HC-Y104E heavy chain variable domain amino acid S119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGQGTLVTVSS

SEQ ID NO: 11889 - protein, 119 aa, Artificial Sequence
  Description of Artificial Sequence: Synthetic polypeptide
  HC-D72L/HC-Y104E heavy chain variable domain amino acid A119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGQGTLVTVSA

SEQ ID NO: 11890 - protein, 119 aa, Artificial Sequence
  Description of Artificial Sequence: Synthetic polypeptide
  HC-D72L/HC-Y104E/HC-Q111P heavy chain variable domain amino acid S119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGPGTLVTVSS

SEQ ID NO: 11891 - protein, 119 aa, Artificial Sequence
  Description of Artificial Sequence: Synthetic polypeptide
  HC-D72L/HC-Y104E/HC-Q111P heavy chain variable domain amino acid A119
QVQLKQSGPGLVQPSQSLSITCTVSGFSLTNYGVHWVRQSPGKGLEWLGVIWSGGNTDYNTPFTSRLSINKLNSKSQVFFKMNSLQSNDTAIYYCARALTYYDEEFAYWGPGTLVTVSA

SEQ ID NO: 11892 - protein, 119 aa, Artificial Sequence
  Description of Artificial Sequence: Synthetic polypeptide
  HC-S53G/HC-D72L/HC-Y104E heavy chain variable domain amino acid S119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGQGTLVTVSS

SEQ ID NO: 11893 - protein, 119 aa, Artificial Sequence
  Description of Artificial Sequence: Synthetic polypeptide
  HC-S53G/HC-D72L/HC-Y104E heavy chain variable domain amino acid A119
QVQLKQSGPGLVQPSQSLSITCTVSGFSLTNYGVHWVRQSPGKGLEWLGVIWGGGNTDYNTPFTSRLSINKLNSKSQVFFKMNSLQSNDTAIYYCARALTYYDEEFAYWGQGTLVTVSA

SEQ ID NO: 11894 - protein, 119 aa, Artificial Sequence
  Description of Artificial Sequence: Synthetic polypeptide
  EP-h1, 2, 4, 5, 6, 8 heavy chain variable domain amino acid S119
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDEEFAYWGPGTLVTVSS

SEQ ID NO: 11895 - protein, 119 aa, Artificial Sequence
  Description of Artificial Sequence: Synthetic polypeptide
  EP-h1, 2, 4, 5, 6, 8 heavy chain variable domain amino acid A119
QVQLQQSGPGLVKPSQTLSLTCAISGFSLTNYGVHWIRQPPGKGLEWIGVIWSGGNTDYNTPFTSRFTISRDDSKNTAYLQMNSLKTEDTAVYYCARALTYYDEEFAYWGPGTLVTVSA

SEQ ID NO: 11896 - protein, 119 aa, Artificial Sequence
  Description of Artificial Sequence: Synthetic polypeptide
  EP-h3, 7 heavy chain variable domain amino acid S119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGPGTLVTVSS

SEQ ID NO: 11897 - protein, 119 aa, Artificial Sequence
  Description of Artificial Sequence: Synthetic polypeptide
  EP-h3, 7 heavy chain variable domain amino acid A119
EVQLVQSGAEVKKPGATVKISCKVSGFSLTNYGVHWVRQATGQGLEWMGVIWSGGNTDYNTPFTSRFTISRDDSKNTAYLQMNSLKTEDTAVYYCARALTYYDEEFAYWGPGTLVTVSA

SEQ ID NO: 11898 - protein, 119 aa, Artificial Sequence
  Description of Artificial Sequence: Synthetic polypeptide
  EP-h9, 12, 14 heavy chain variable domain amino acid S119
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDEEFAYWGPGTLVTVSS

SEQ ID NO: 11899 - protein, 119 aa, Artificial Sequence
  Description of Artificial Sequence: Synthetic polypeptide
  EP-h9, 12, 14 heavy chain variable domain amino acid A119
EVQLVQSGAEVKKPGATVKISCKVSGFSLTNYGVHWIRQSPSRGLEWLGVIWSGGNTDYNTPFTSRLTISKDTSKNQVVLTMTNMDPVDTATYYCARALTYYDEEFAYWGPGTLVTVSA

SEQ ID NO: 11900 - protein, 119 aa, Artificial Sequence
  Description of Artificial Sequence: Synthetic polypeptide
  EP-h10, 13 heavy chain variable domain amino acid S119
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDEEFAYWGPGTLVTVSS

SEQ ID NO: 11901 - protein, 119 aa, Artificial Sequence
  Description of Artificial Sequence: Synthetic polypeptide
  EP-h10, 13 heavy chain variable domain amino acid A119
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDEEFAYWGPGTLVTVSA

SEQ ID NO: 11902 - protein, 119 aa, Artificial Sequence
  Description of Artificial Sequence: Synthetic polypeptide
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDEEFAYWGPGTLVTVSS

SEQ ID NO: 11903 - protein, 119 aa, Artificial Sequence
  Description of Artificial Sequence: Synthetic polypeptide
EVQLVQSGAEVKKPGATVKISCKVSGFSLFNYGVHWIRQPPGKGLEWIGVIWSGGNTDYNTPFTSRFTISRDNSKNTLYLQMNSLRAEDTAVYYCARALTYYDEEFAYWGPGTLVTVSA

SEQ ID NO: 11904 - protein, 119 aa, Artificial Sequence
  Description of Artificial Sequence: Synthetic polypeptide
  FEP-h2 heavy chain variable domain amino acid S119
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDEEFAYWGPGTLVTVSS

SEQ ID NO: 11905 - protein, 119 aa, Artificial Sequence
  Description of Artificial Sequence: Synthetic polypeptide
  FEP-h2 heavy chain variable domain amino acid A119
EVQLVQSGAEVKKPGATVKISCKVSGFSLFNYGVHWVRQARGQRLEWIGVIWSGGNTDYNTPFTSRFTISRDDSKNTAYLQMNSLKTEDTAVYYCARALTYYDEEFAYWGPGTLVTVSA

SEQ ID NO: 11906 - protein, 119 aa, Artificial Sequence
  Description of Artificial Sequence: Synthetic polypeptide
  FEP-h3, 7, 11, 15 heavy chain variable domain amino acid S119
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDEEFAYWGPGTLVTVSS

SEQ ID NO: 11907 - protein, 119 aa, Artificial Sequence
  Description of Artificial Sequence: Synthetic polypeptide
  FEP-h3, 7, 11, 15 heavy chain variable domain amino acid A119
EVQLVQSGAEVKKPGATVKISCKVSGFSLFNYGVHWVRQATGQGLEWMGVIWSGGNTDYNTPFTSRFTISRDDSKNTAYLQMNSLKTEDTAVYYCARALTYYDEEFAYWGPGTLVTVSA

SEQ ID NO: 11908 - protein, 119 aa, Artificial Sequence
  Description of Artificial Sequence: Synthetic polypeptide
  FEP-h4, 8, 12, 16 heavy chain variable domain amino acid S119
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDEEFAYWGPGTLVTVSS

SEQ ID NO: 11909 - protein, 119 aa, Artificial Sequence
  Description of Artificial Sequence: Synthetic polypeptide
  FEP-h4, 8, 12, 16 heavy chain variable domain amino acid A119
QVQLQQSGPGLVKPSQTLSLTCAISGFSLFNYGVHWIRQSPSRGLEWLGVIWSGGNTDYNTPFTSRLTISKDTSKNQVVLTMTNMDPVDTATYYCARALTYYDEEFAYWGPGTLVTVSA

SEQ ID NO: 11910 - protein, 119 aa, Artificial Sequence
  Description of Artificial Sequence: Synthetic polypeptide
  FEP-h6 heavy chain variable domain amino acid S119
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDEEFAYWGPGTLVTVSS

SEQ ID NO: 11911 - protein, 119 aa, Artificial Sequence
  Description of Artificial Sequence: Synthetic polypeptide
  FEP-h6 heavy chain variable domain amino acid A119
EVQLVQSGAEVKKPGATVKISCKVSGFSLFNYGVHWIRQSPSRGLEWLGVIWSGGNTDYNTPFTSRFTISRDNSKNTLYLQMNSLRAEDTAVYYCARALTYYDEEFAYWGPGTLVTVSA

SEQ ID NO: 11912 - protein, 119 aa, Artificial Sequence
  Description of Artificial Sequence: Synthetic polypeptide
  FEP-h10, 14, 18 heavy chain variable domain amino acid S119
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDEEFAYWGPGTLVTVSS

SEQ ID NO: 11913 - protein, 119 aa, Artificial Sequence
  Description of Artificial Sequence: Synthetic polypeptide
  FEP-h10, 14, 18 heavy chain variable domain amino acid A119
EVQLVQSGAEVKKPGATVKISCKVSGFSLFNYGVHWIRQPPGKGLEWIGVIWSGGNTDYNTPFTSRFTISRDDSKNTAYLQMNSLKTEDTAVYYCARALTYYDEEFAYWGPGTLVTVSA

SEQ ID NO: 11914 - protein, 119 aa, Artificial Sequence
  Description of Artificial Sequence: Synthetic polypeptide
  HC-F27G/HC-Y104E heavy chain variable domain amino acid S119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGQGTLVTVSS

SEQ ID NO: 11915 - protein, 119 aa, Artificial Sequence
  Description of Artificial Sequence: Synthetic polypeptide
  HC-F27G/HC-Y104E heavy chain variable domain amino A119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGQGTLVTVSA

SEQ ID NO: 11916 - protein, 119 aa, Artificial Sequence
  Description of Artificial Sequence: Synthetic polypeptide
  HC-F27G/HC-Y104E/HC-Q111P heavy chain variable domain amino acid S119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGPGTLVTVSS

SEQ ID NO: 11917 - protein, 119 aa, Artificial Sequence
  Description of Artificial Sequence: Synthetic polypeptide
  HC-F27G/HC-Y104E/HC-Q111P heavy chain variable domain amino acid A119
QVQLKQSGPGLVQPSQSLSITCTVSGGSLTNYGVHWVRQSPGKGLEWLGVIWSGGNTDYNTPFTSRLSINKDNSKSQVFFKMNSLQSNDTAIYYCARALTYYDEEFAYWGPGTLVTVSA

SEQ ID NO: 11918 - protein, 119 aa, Artificial Sequence
  Description of Artificial Sequence: Synthetic polypeptide
  HC-F27G/HC-S53G/HC-Y104E heavy chain variable domain amino acid S119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGQGTLVTVSS

SEQ ID NO: 11919 - protein, 119 aa, Artificial Sequence
  Description of Artificial Sequence: Synthetic polypeptide
  HC-F27G/HC-S53G/HC-Y104E heavy chain variable domain amino acid A119
QVQLKQSGPGLVQPSQSLSITCTVSGGSLTNYGVHWVRQSPGKGLEWLGVIWGGGNTDYNTPFTSRLSINKDNSKSQVFFKMNSLQSNDTAIYYCARALTYYDEEFAYWGQGTLVTVSA

SEQ ID NO: 11920 - protein, 116 aa, Artificial Sequence
  Description of Artificial Sequence: Synthetic polypeptide
EVQLQESGPGLVKPSQTLSLTCTVSGYSISRDFAWNWIRQPPGKGLEWMGYISYNGNTRYQPSLKSRITISRDTSKNQFFLKLNSVTAADTATYYCVTASRGFPYWGQGTLVTVSS

SEQ ID NO: 11921 - protein, 116 aa, Artificial Sequence
  Description of Artificial Sequence: Synthetic polypeptide
EVQLQESGPGLVKPSQTLSLTCTVSGYSISNDFAWNWIRQPPGKGLEWMGYISYKGNTRYQPSLKSRITISRDTSKNQFFLKLNSVTAADTATYYCVTASRGFPWWGQGTLVTVSS

SEQ ID NO: 11922 - protein, 116 aa, Artificial Sequence
  Description of Artificial Sequence: Synthetic polypeptide
EVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSS

SEQ ID NO: 11923 - protein, 116 aa, Artificial Sequence
  Description of Artificial Sequence: Synthetic polypeptide
EVQLQESGPGLVKPSQTLSLTCTVSGYSISRDFAWNWIRQPPGKGLEWMGYISYSGNTRYQPSLKSRITISRDTSKNQFFLKLNSVTAADTATYYCVTASRGFPYWGQGTLVTVSS

SEQ ID NO: 11924 - protein, 116 aa, Artificial Sequence
  Description of Artificial Sequence: Synthetic polypeptide
EVQLQESGPGLVKPSQTLSLTCTVSGYSISNDFAWNWIRQLPGKGLEWMGYISYKGNTRYQPSLKSRITISRDTSKNQFFLKLNSVTAADTATYYCVTASRGLPYWGQGTLVTVSS

SEQ ID NO: 11925 - protein, 116 aa, Artificial Sequence
  Description of Artificial Sequence: Synthetic polypeptide
EVQLQESGPGLVKPSQTLSLTCTVSGYSIGKDFAWNWIRQPPGKGLEWMGYISYNGNTRYQPSLKSRITISRDTSKNQFFLKLNSVTAADTATYYCVTASRGLPYWGQGTLVTVSS

SEQ ID NO: 11926 - protein, 116 aa, Artificial Sequence
  Description of Artificial Sequence: Synthetic polypeptide
EVQLQESGPGLVKPSQTLSLTCTVSGYSIGKDFAWNWIRQPPGKGLEWMGYISYSGNTRYQPSLKSRITISRDTSKNQFFLKLNSVTAADTATYYCVTASRGLPYWGQGTLVTVSS

SEQ ID NO: 11927 - protein, 116 aa, Artificial Sequence
  Description of Artificial Sequence: Synthetic polypeptide
EVQLQESGPGLVKPSQTLSLTCTVSGYSISRDFAWNWIRQPPGKGLEWMGYISYNGNTRYQPSLKSRITISRDTSKNQFFLKLNSVTAADTATYYCVTASRGFPWWGQGTLVTVSS

SEQ ID NO: 11928 - protein, 116 aa, Artificial Sequence
  Description of Artificial Sequence: Synthetic polypeptide
EVQLQESGPGLVKPSQTLSLTCTVSGYSIGRDFAWNWIRQPPGKGLEWMGYISYNGNTRYQPSLKSRITISRDTSKNQFFLKLNSVTAADTATYYCVTASRGFPYWGQGTLVTVSS

SEQ ID NO: 11929 - protein, 116 aa, Artificial Sequence
  Description of Artificial Sequence: Synthetic polypeptide
EVQLQESGPGLVKPSQTLSLTCTVSGYSIGRDFAWNWIRQPPGKGLEWMGYISYSGNTRYQPSLKSRITISRDTSKNQFFLKLNSVTAADTATYYCVTASRGFPYWGQGTLVTVSS

SEQ ID NO: 11930 - protein, 116 aa, Artificial Sequence
  Description of Artificial Sequence: Synthetic polypeptide
EVQLQESGPGLVKPSQTLSLTCTVSGYSIGKDFAWNWIRQPPGKGLEWMGYISYNGNTRYQPSLKSRITISRDTSKNQFFLKLNSVTAADTATYYCVTASRGFPYWGQGTLVTVSS

SEQ ID NO: 11931 - protein, 116 aa, Artificial Sequence
  Description of Artificial Sequence: Synthetic polypeptide
EVQLQESGPGLVKPSQTLSLTCTVSGYSISHDFAWNWIRQPPGKGLEWMGYISYNGNTRYQPSLKSRITISRDTSKNQFFLKLNSVTAADTATYYCVTASWGLPWWGQGTLVTVSS

SEQ ID NO: 11932 - protein, 116 aa, Artificial Sequence
  Description of Artificial Sequence: Synthetic polypeptide
EVQLQESGPGLVKPSQTLSLTCTVSGYSISHDFAWNWIRQPPGKGLEWMGYISYSGNTRYQPSLKSRITISRDTSKNQFFLKLNSVTAADTATYYCVTASWGLPWWGQGTLVTVSS

SEQ ID NO: 11933 - protein, 121 aa, Homo sapiens
QVQLQQSGAELMKPGASVKISCKATGYTFSSYWIEWVKQRPGHGLEWIGEILPGSKKTNYNEKFKGKATFTADTSSNTAYMQFSSLTSEDSAVYYCARYYYRNDDYGMDYWGQGTSVTVSS

SEQ ID NO: 11934 - protein, 117 aa, Mus musculus
DVQLQESGPGLVKPSQSLSLTCTVTGYSITSDYAWNWIRLFPGNKLEWMGFINYSGNTSYNPSLKSRISITRDTSKNQFFLKLNSLTTDDTATYYCARGGLSRFPYWGQGTLVTVSA

SEQ ID NO: 11935 - protein, 119 aa, Artificial Sequence; identical to SEQ ID NO: 6388
  Description of Artificial Sequence: Synthetic polypeptide
  1-119: humanized heavy chain variable region

SEQ ID NO: 11936 - protein, 119 aa, Artificial Sequence; identical to SEQ ID NO: 6389
  Description of Artificial Sequence: Synthetic polypeptide
  1-119: mouse heavy chain variable region

SEQ ID NO: 11937 - protein, 119 aa, Artificial Sequence
  Description of Artificial Sequence: Synthetic polypeptide
  synthetic construct
QVTLKESGPVLVKPTETLTLTCTVSGFSLSNWGVHWIRQPPGKALEWLAVIWSGGNTDYNTPFDSRLTISKDTSKSQVVLTMTNMDPVDTATYYCARALDYYDYDFAYWGQGTMVTVSS

SEQ ID NO: 11938 - protein, 119 aa, Artificial Sequence
  Description of Artificial Sequence: Synthetic polypeptide
  synthetic construct
QVTLKESGPVLVKPTETLTLTCTVSGFSLSNWDVHWIRQPPGKALEWLAVIWSGGNTDYNTPFASRLTISKDTSKSQVVLTMTNMDPVDTATYYCARALDYYDYNFAYWGQGTMVTVSS

SEQ ID NO: 11939 - protein, 119 aa, Artificial Sequence
  Description of Artificial Sequence: Synthetic polypeptide
  synthetic construct
QVTLKESGPVLVKPTETLTLTCTVSGFSLSNWDVHWIRQPPGKALEWLAVIWSGGATDYNTPFNSRLTISKDTSKSQVVLTMTNMDPVDTATYYCARALDYYDYNFAYWGQGTMVTVSS

SEQ ID NO: 11940 - protein, 119 aa, Artificial Sequence
  Description of Artificial Sequence: Synthetic polypeptide
  synthetic construct
QVTLKESGPVLVKPTETLTLTCTVSGFSLSNWDVHWIRQPPGKALEWLAVIWSGGNTDYNTPFTSRLTISKDTSKSQVVLTMTNMDPVDTATYYCARALDYYDYEFAYWGQGTMVTVSS

SEQ ID NO: 11941 - protein, 119 aa, Artificial Sequence
  Description of Artificial Sequence: Synthetic polypeptide
  synthetic construct
QVTLKESGPVLVKPTETLTLTCTVSGFSLSNWDVHWIRQPPGKALEWLAVIWSGGNTDYNTPFTSRLTISKDTSKSQVVLTMTNMDPVDTATYYCARALDYYDYDFAYWGQGTMVTVSS

SEQ ID NO: 11942 - protein, 119 aa, Artificial Sequence
  Description of Artificial Sequence: Synthetic polypeptide
  synthetic construct
QVQLQESGPGLVKPSETLSLTCTVSGFSLTNWDVHWIRQPPGKGLEWIGNIWSGGNTDYNTPFTSRVTISVDTSKNQFSLKLSSVTAADTAVYYCARALDYYDYDYAYWGQGTMVTVSS

SEQ ID NO: 11943 - protein, 119 aa, Artificial Sequence
  Description of Artificial Sequence: Synthetic polypeptide
  synthetic construct
QVQLQESGPGLVKPSETLSLTCTVSGFSLTNYGVHWIRQPPGKGLEWIGNIWSGGNTDYNTPFTSRVTISVDTSKNQFSLKLSSVTAADTAVYYCARALDYYDYDYAYWGQGTMVTVSS

SEQ ID NO: 11944 - protein, 119 aa, Artificial Sequence
  Description of Artificial Sequence: Synthetic polypeptide
  synthetic construct
QVQLQESGPGLVKPSETLSLTCTVSGFSLTNWDVHWIRQPPGKGLEWIGVIWSGGNTDYNTPFTSRVTISVDTSKNQFSLKLSSVTAADTAVYYCARALDYYDYDFAYWGQGTMVTVSS

SEQ ID NO: 11945 - protein, 120 aa, Artificial Sequence
  Description of Artificial Sequence: Synthetic polypeptide
  Chimeric rat-human sequence (I-HHD-1)
QVQLVQSGAEVKKPGSSVKVSCKASGGTFTDYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 11946 - protein, 120 aa, Artificial Sequence
  Description of Artificial Sequence: Synthetic polypeptide
  Chimeric rat-human sequence (I-HHD-2)
QVQLVQSGAEVKKPGSSVKVSCKASGFSFTDYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 11947 - protein, 120 aa, Artificial Sequence
  Description of Artificial Sequence: Synthetic polypeptide
  Chimeric rat-human sequence (I-HHD-3)
QVQLVQSGAEVKKPGSSVKVSCKASGFTITDYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 11948 - protein, 120 aa, Artificial Sequence
  Description of Artificial Sequence: Synthetic polypeptide
  Chimeric rat-human sequence (I-HHD-4)
QVQLVQSGAEVKKPGSSVKVSCKASGFTFTEYKIHWVRQAPGQGLEWMGYFNPNSGYSTYAQKFQGRVTITADKSTSTAYMELSSLRSEDTAVYYCARLSPGGYYVMDAWGQGTTVTVSS

SEQ ID NO: 11949 - protein, 120 aa, Artificial Sequence
  Description of Artificial Sequence: Synthetic polypeptide
  Chimeric rat-human sequence (I-HHD-5)
QVQLVQSGAEVKKPGSSVKVSCKASGFTFTDYKIHWVRQAPGQGLEWMGYFTPNSGYSTYAQKFQGRVTITADKSTSTAYMELSSLRSEDTAVYYCARLSPGGYYVMDAWGQGTTVTVSS

SEQ ID NO: 11950 - protein, 120 aa, Artificial Sequence
  Description of Artificial Sequence: Synthetic polypeptide
  Chimeric rat-human sequence (I-HHD-6)
QVQLVQSGAEVKKPGSSVKVSCKASGFTFTDYKIHWVRQAPGQGLEWMGYFNANSGYSTYAQKFQGRVTITADKSTSTAYMELSSLRSEDTAVYYCARLSPGGYYVMDAWGQGTTVTVSS

SEQ ID NO: 11951 - protein, 120 aa, Artificial Sequence
  Description of Artificial Sequence: Synthetic polypeptide
  Chimeric rat-human sequence (I-HHD-7)
QVQLVQSGAEVKKPGSSVKVSCKASGFTFTDYKIHWVRQAPGQGLEWMGYFNPISGYSTYAQKFQGRVTITADKSTSTAYMELSSLRSEDTAVYYCARLSPGGYYVMDAWGQGTTVTVSS

SEQ ID NO: 11952 - protein, 120 aa, Artificial Sequence
  Description of Artificial Sequence: Synthetic polypeptide
  Chimeric rat-human sequence (I-HHD-8)
QVQLVQSGAEVKKPGSSVKVSCKASGFTFTDYKIHWVRQAPGQGLEWMGYFNPNSGTSTYAQKFQGRVTITADKSTSTAYMELSSLRSEDTAVYYCARLSPGGYYVMDAWGQGTTVTVSS

SEQ ID NO: 11953 - protein, 120 aa, Artificial Sequence
  Description of Artificial Sequence: Synthetic polypeptide
  Chimeric rat-human sequence (I-HHD-9)
QVQLVQSGAEVKKPGSSVKVSCKASGFTFTDYKIHWVRQAPGQGLEWMGYFNPNSGYATYAQKFQGRVTITADKSTSTAYMELSSLRSEDTAVYYCARLSPGGYYVMDAWGQGTTVTVSS

SEQ ID NO: 11954 - protein, 120 aa, Artificial Sequence
  Description of Artificial Sequence: Synthetic polypeptide
  Chimeric rat-human sequence (I-HHD-10)
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYGMDAWGQGTTVTVSS

SEQ ID NO: 11955 - protein, 124 aa, Homo sapiens; identical to SEQ ID NO: 4955

SEQ ID NO: 11956 - protein, 120 aa, Homo sapiens
RAQVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVS

SEQ ID NO: 11957 - protein, 120 aa, Homo sapiens
RAEVQLVESGGGLVKPGGSLKLSCAASGFTFSSYALSWVRQTPERRLEWVASISGVGSTYFPDSVKGRFTMSRDNARNILYLQMSSLRSEDTAMYYCARGSDGYFYAMDYWGQGTSVTVS

SEQ ID NO: 11958 - protein, 120 aa, Homo sapiens
RAQVQLQQPGAELVKPGASVKLSCKASGYTFTSHWMHWVQQRPGQGLEWIGEIHPSNGRTNYNEKFKNKATLTVDKSPSTAYMQLSSLTSEDSAVYYCARYYGYDDAMDYWGQGTSVTVS

SEQ ID NO: 11959 - protein, 122 aa, Homo sapiens
RAEVQLVESGGGLVKPGGSLKLSCAASGFAFSSYDMSWVRQTPEKRLEWVAYIGSGDDNTHYPDSVKGRFTISRHNAKNTLYLQMSSLKSEDTAMYYCARQKYGNYGDTMDYWGQGTSVTVS

SEQ ID NO: 11960 - protein, 122 aa, Homo sapiens
RAQVQLKESGPGLVAPSQSLSITCSVSGFSLTIYGVHWVRQPPGKGLEWLGVMWAGGNTDYNSALMSRLNISKDNSKSQVFLKVNSLQTDDTAMYYCTRDPDGYYVGWFFDVWGAGTTVTVS

SEQ ID NO: 11961 - protein, 122 aa, Homo sapiens
RAEVQLVESGGGLVKPGGSLKLSCAASGFAYSTYDMSWVRQTPEKRLEWVAYISSGGDAAYYPDTVKGRFTISRDNAKNTLYLQMSSLKSEDTAMYYCARSRYGNYGDAMDYWGQGTSVTVS

SEQ ID NO: 11962 - protein, 125 aa, Homo sapiens
RAEVQLQQSGPELVKPGASVKIPCKTSGYTFTDYNMAWVKQSHGKSLEWIGDIIPNNGGAIYNQKFKGKATLTVDKSSSTASMELRSLTSEDTAVYFCARKNIYYRYDGAGALDYWGQGTSVTVS

SEQ ID NO: 11963 - protein, 117 aa, Homo sapiens
RAQVQLKESGPGLVAPSQSLSITCTVSGFSLTTYGVHWVRQPPGKGLEWLGVIWAGGSTNYNSALMSRLSIKKDNSKSQVFLKMNSLQTDDTAMYYCARAYGYNFDYWGQGTTLTVS

SEQ ID NO: 11964 - protein, 124 aa, Homo sapiens
RAEVQLVESGGGLVKPGGSLKLSCAVSGFTFSSYVMSWVRQTPEKRLEWVATITSGGRNIYYLDSVKGRFTISRDNAKNTLYLQMSSLRSEDTAMYYCARHEDYRYDGYYAMDYWGQGTSVTVS

SEQ ID NO: 11965 - protein, 118 aa, Homo sapiens
RAEVQLVESGGGLVKPGESLKLSCAASGFAFSYSDMSWVRQTPEKRLEWVAYMSSAGDVTFYSDTVKGRFTISRDNAKNTLYLQVSSLKSEDTAIYYCVRHRDVAMDYWGQGTSVTVS

SEQ ID NO: 11966 - protein, 119 aa, Homo sapiens
RAQVQLQQPGAELVKPGASVKLSCKASGYTFTSDWMHWMKQRPGQGLEWIGEINPSNGRSSYNEKFKSKATLTVDKSSSTAYMQLSSLTSEDSAVYYCARIGGIYVETYWGQGTLVTVS

SEQ ID NO: 11967 - protein, 125 aa, Homo sapiens
RAEVQLQQSGAELVRPGSSVKISCKASGYAFSSYWMNWVRQRPGQGLEWIGQIYPGDGDTNYNGKFKGRATLTANKSSSTAYMQLSSLTSEDSAVYFCARRASSLYDVYPYYFDYWGQGTTLTVS

SEQ ID NO: 11968 - protein, 121 aa, Homo sapiens
RAQVQLQQPGAELVKPGASMKLSCKASGYTFTNYWMHWVKQRPGQGLEWIGEINPSNGRTNYNEKFKSKATLTVDKSSSTAYMQLSSLTSEDSGVYYCAKGGNYYDYDWDYWGQGTTLTVS

SEQ ID NO: 11969 - protein, 117 aa, Homo sapiens
RAQVQLKESGPGLVAPSQSLSITCTVSGFSLTIYGVHWVRQPPGKGLEWLGVIWAGGNTNYNSALMSRLSISKDNSKSQVFLKMNSLQTDDTAMYFCARGYGYNLDYWGQGTTLTVS

SEQ ID NO: 11970 - protein, 119 aa, Homo sapiens
RAQVQLKESGPGLVAPSQSLSITCTVSGFSLTGHGVNWVRQPPGKGLEWLGMIWGDGSTDYNSTLKSRLSISKDNSKSQVFLKMNSLQTDDTARYYCARGYGYLYYFDYWGQGTTLTVS

SEQ ID NO: 11971 - protein, 249 aa, Artificial Sequence
  Description of Artificial Sequence: Synthetic polypeptide
  synthetic construct
RAEVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVSSASTKGPQVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVS

SEQ ID NO: 11972 - protein, 249 aa, Artificial Sequence
  Description of Artificial Sequence: Synthetic polypeptide
  synthetic construct
RAQVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSSASTKGPEVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVS

SEQ ID NO: 11973 - protein, 122 aa, Artificial Sequence
  Description of Artificial Sequence: Synthetic polypeptide
  synthetic construct
QVQLVQSGAEVKKPGASVKVSCKASGYTFTSYWMHWVRQAPGQGLEWMGIIYPGSRSTSYAQKFQGRVTMTRDTSTSTVYMELSSLRSEDTAVYYCTRNGDYYVSSGDAMDYWGQGTLVTVS

SEQ ID NO: 11974 - protein, 118 aa, Artificial Sequence
  Description of Artificial Sequence: Synthetic polypeptide
  synthetic construct
QVQLVQSGAEVKKPGASVKVSCKASGYTFTSHWMHWVRQAPGQGLEWMGWINPSSGRNNYAQKFQGRVTMTRDTSISTAYMELSRLTSDDTAVYYCARYYGYDEAMDYWGQGTSVTVS

SEQ ID NO: 11975 - protein, 621 aa, Homo sapiens
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPKDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPS

SEQ ID NO: 11976 - protein, 125 aa, Homo sapiens [sequence omitted]

SEQ ID NO: 11977 - protein, 122 aa, Artificial Sequence
  Description of Artificial Sequence: Synthetic polypeptide
  Synthetic construct of heavy chain variable region
EVQLVESGGGVVQPGGSLRLSCAASGFTFSDYDMSWIRQAPGKGLEWVSGILGGSERSYYRDSVKGRFTISRDNSRKTLYLQMNSLRAEDTAVYYCARHGSPGYTLYAWDYWGQGTTVTVSS

SEQ ID NO: 11978 - protein, 119 aa, Artificial Sequence
  Description of Artificial Sequence: Synthetic polypeptide
  hvH
  MOD_RES (6)..(6): Glu or Gln
  MOD_RES (27)..(27): Gly or Phe
  MOD_RES (40)..(40): Pro or Ser
  MOD_RES (70)..(70): Ser or Asn
  MOD_RES (71)..(71): Val or Lys
  MOD_RES (73)..(73): Thr or Asn
  MOD_RES (76)..(76): Asn or Ser
  MOD_RES (78)..(78): Phe or Val
  MOD_RES (80)..(80): Leu or Phe
  MOD_RES (82)..(82): Leu or Met
  MOD_RES (88)..(88): Ala or Asn
QVQLQXSGPGLVKPSETLSLTCTVSGXSISNYGVHWIRQXPGKGLEWIGVIWSGGNTDYNTPFTSRVTIXXDXSKXQXSXKXSSVTAXDTAVYYCARALTYYDYEFAYWGQGTLVTVSA

SEQ ID NO: 11979 - protein, 119 aa, Artificial Sequence
  Description of Artificial Sequence: Synthetic polypeptide
  hVh1
QVQLQESGPGLVKPSETLSLTCTVSGGSISNYGVHWIRQPPGKGLEWIGVIWSGGNTDYNTPFTSRVTISVDTSKNQFSLKLSSVTAADTAVYYCARALTYYDYEFAYWGQGTLVTVSA

SEQ ID NO: 11980 - protein, 119 aa, Artificial Sequence
  Description of Artificial Sequence: Synthetic polypeptide
  hVh2
QVQLQESGPGLVKPSETLSLTCTVSGFSISNYGVHWIRQPPGKGLEWIGVIWSGGNTDYNTPFTSRVTISKDTSKNQVSLKLSSVTAADTAVYYCARALTYYDYEFAYWGQGTLVTVSA

SEQ ID NO: 11981 - protein, 119 aa, Artificial Sequence
  Description of Artificial Sequence: Synthetic polypeptide
  hVh4
QVQLQESGPGLVKPSETLSLTCTVSGGSISNYGVHWIRQPPGKGLEWIGVIWSGGNTDYNTPFTSRVTINKDNSKSQVSFKMSSVTAADTAVYYCARALTYYDYEFAYWGQGTLVTVSA

SEQ ID NO: 11982 - protein, 119 aa, Artificial Sequence
  Description of Artificial Sequence: Synthetic polypeptide
  hVh5
QVQLQQSGPGLVKPSETLSLTCTVSGFSISNYGVHWIRQSPGKGLEWIGVIWSGGNTDYNTPFTSRVTINKDNSKSQFSLKLSSVTAADTAVYYCARALTYYDYEFAYWGQGTLVTVSA

SEQ ID NO: 11983 - protein, 119 aa, Artificial Sequence
  Description of Artificial Sequence: Synthetic polypeptide
  hVh6
QVQLQESGPGLVKPSETLSLTCTVSGFSISNYGVHWIRQSPGKGLEWIGVIWSGGNTDYNTPFTSRVTISVDTSKNQFSLKLSSVTAADTAVYYCARALTYYDYEFAYWGQGTLVTVSA

SEQ ID NO: 11984 - protein, 119 aa, Artificial Sequence
  Description of Artificial Sequence: Synthetic polypeptide
  hVh7
QVQLQQSGPGLVKPSETLSLTCTVSGFSISNYGVHWIRQPPGKGLEWIGVIWSGGNTDYNTPFTSRVTINKDNSKSQVSFKMSSVTAADTAVYYCARALTYYDYEFAYWGQGTLVTVSA

SEQ ID NO: 11985 - protein, 119 aa, Artificial Sequence
  Description of Artificial Sequence: Synthetic polypeptide
  hVh8
QVQLQQSGPGLVKPSETLSLTCTVSGFSISNYGVHWIRQSPGKGLEWIGVIWSGGNTDYNTPFTSRVTINKDNSKSQVSFKMSSVTAADTAVYYCARALTYYDYEFAYWGQGTLVTVSA

SEQ ID NO: 11986 - protein, 95 aa, Homo sapiens
QVQLQESGPGLVKPSETLSLTCTVSGGSISSYWSWIRQPPGKGLEWIGYYYSGSTNYNPSLKSRVTISVDTSKNQFSLKLSSVTAADTAVYYCAR

SEQ ID NO: 11987 - protein, 119 aa, Artificial Sequence
  Description of Artificial Sequence: Synthetic polypeptide
  muEGFR-7 VH
QVQLQQSGAELARPGASVKLSCKASGYTFTSYWMQWVKQRPGQGLECIGTIYPGDGDTTYTQKFKGKATLTADKSSSTAYMQLSSLASEDSAVYYCARYDAPGYAMDYWGQGTSVTVSS

SEQ ID NO: 11988 - protein, 119 aa, Artificial Sequence
  Description of Artificial Sequence: Synthetic polypeptide
QVQLQQSGTELARPGASVKLSCKASGYTFTSYWMQWVKQRPGQGLECIGTIYPGDGDTRYIQKFKGKATLTADKSSSTAYMQLSSLASEDSAVYYCARYDAPGYAMDYWGQGTSVTVSS

SEQ ID NO: 11989 - protein, 119 aa, Artificial Sequence
  Description of Artificial Sequence: Synthetic polypeptide
  huEGFR-7 VH
QVQLVQSGAEVAKPGASVKLSCKASGYTFTSYWMQWVKQRPGQGLECIGTIYPGDGDTTYTQKFQGKATLTADKSSSTAYMQLSSLRSEDSAVYYCARYDAPGYAMDYWGQGTLVTVSS

SEQ ID NO: 11990 - protein, 119 aa, Artificial Sequence
  Description of Artificial Sequence: Synthetic polypeptide
  huEGFR-7 VH
QVQLVQSGAEVKKPGASVKVSCKASGYTFTSYWMQWVRQAPGQGLEWMGTIYPGDGDTTYTQKFKGRVTMTRDTSTSTVYMELSSLRSEDTAVYYCARYDAPGYAMDYWGQGTLVTVSS

SEQ ID NO: 11991 - protein, 119 aa, Artificial Sequence
  Description of Artificial Sequence: Synthetic polypeptide
  huEGFR-12 VH
QVQLVQSGAEVAKPGASVKLSCKASGYTFTSYWMQWVKQRPGQGLECIGTIYPGDGDTRYIQKFQGKATLTADKSSSTAYMQLSSLRSEDSAVYYCARYDAPGYAMDYWGQGTLVTVSS

SEQ ID NO: 11992 - protein, 119 aa, Artificial Sequence
  Description of Artificial Sequence: Synthetic polypeptide
QVQLQQSGAELARPGASVKLSCKASGYTFTSYWMQWVKQRPGQGLECIGALYPGDGDARYTQKFKGKATLTADRSSSTAYMQLSSLASEDSAVYYCARYDAPGYAMDYWGQGTSVTVAS

SEQ ID NO: 11993 - protein, 119 aa, Artificial Sequence
  Description of Artificial Sequence: Synthetic polypeptide
  huEGFR-6 VH v1.0
QVQLVQSGAEVAKPGASVKLSCKASGYTFTSYWMQWVKQRPGQGLECIGALYPGDGDARYTQKFQGKATLTADTSSSTAYMQLSSLRSEDSAVYYCARYDAPGYAMDYWGQGTLVTVSS

SEQ ID NO: 11994 - protein, 119 aa, Artificial Sequence
  Description of Artificial Sequence: Synthetic polypeptide
  huEGFR-6 VH v1.11
QVQLVQSGAEVAKPGASVKLSCKASGYTFTSYWMQWVKQRPGQGLEWIGALYPGDGDARYTQKFQGKATLTADTSSSTAYMQLSSLRSEDSAVYYCARYDAPGYAMDYWGQGTLVTVSS

SEQ ID NO: 11995 - protein, 119 aa, Artificial Sequence
  Description of Artificial Sequence: Synthetic polypeptide
  huEGFR-7 VH v1.11
QVQLVQSGAEVAKPGASVKLSCKASGYTFTSYWMQWVKQRPGQGLEWIGTIYPGDGDTTYTQKFQGKATLTADKSSSTAYMQLSSLRSEDSAVYYCARYDAPGYAMDYWGQGTLVTVSS

SEQ ID NO: 11996 - protein, 443 aa, Artificial Sequence
  Description of Artificial Sequence: Synthetic polypeptide
  huEGFR-6 VH v1.11
AAGCTTGCCACCATGGGGTGGAGTTGTATCATCCTCTTCCTTGTCGCTACCGCCACTGGAGTGCATTCCCAGGTGCAGTTGGTGCAATCTGGCGCCGAGGTGGCCAAGCCCGGTGCCTCCGTAAAATTGAGTTGTAAAGCCTCTGGCTATACATTTACATCTTATTGGATGCAGTGGGTCAAGCAGCGCCCTGGTCAAGGCCTGGAGTGGATCGGAGCTCTGTATCCTGGCGACGGGGACGCCCGTTACACTCAGAAATTTCAGGGCAAAGCTACCCTCACCGCAGATACATCCAGCAGCACTGCTTATATGCAACTTAGTAGCCTCCGCAGCGAGGATAGTGCCGTGTACTACTGTGCCAGATATGACGCCCCAGGTTATGCTATGGACTACTGGGGTCAAGGAACCCTGGTGACAGTGTCAAGCGCTAGCACAAAGGGCCC

SEQ ID NO: 11997 - protein, 443 aa, Artificial Sequence
  Description of Artificial Sequence: Synthetic polypeptide
  huEGFR-7 VH v1.11
AAGCTTGCCACCATGGGCTGGTCATGTATCATTCTGTTCCTGGTGGCCACCGCAACCGGTGTCCATTCCCAGGTGCAGCTCGTGCAGAGCGGGGCTGAAGTGGCCAAGCCAGGTGCTTCTGTCAAATTGTCTTGTAAGGCCAGTGGGTACACCTTCACAAGCTACTGGATGCAGTGGGTTAAGCAACGCCCAGGCCAGGGACTGGAGTGGATCGGCACCATTTATCCAGGGGATGGAGATACCACTTATACACAAAAGTTTCAAGGCAAAGCCACCCTGACCGCCGACAAATCCAGCAGCACAGCATACATGCAGCTTTCTAGCCTCAGGTCTGAAGACTCCGCCGTGTACTATTGTGCCCGCTACGACGCCCCCGGCTATGCAATGGATTACTGGGGCCAGGGTACTCTGGTCACAGTGTCCTCCGCCTCTACAAAGGGCCC

SEQ ID NO: 11998 - protein, 117 aa, Artificial Sequence
  Description of Artificial Sequence: Synthetic polypeptide
  Synthetic (heavy chain variable region of AT-VH2)
EVKLVESGGGLVQPGGSLRLSCATSGFTFTDYYMSWVRQPPGKGLEWLGFIRNKANGYTTEYSASVKGRFTISRDNSKSTLYLQMNSLRAEDTATYYCARDNWFAYWGQGTLVTVSS

SEQ ID NO: 11999 - protein, 118 aa, Artificial Sequence
  Description of Artificial Sequence: Synthetic polypeptide
QVQLVQSGAEVKKPGASVKVSCKASGYTFTSYDINWVRQATGQGLEWMGWINPNSDYTGYVQKFQGRVTMTRDTSISTAYMELSSLRSEDTAVYYCATSRWSEHFHHWGQGTLVTVSS

SEQ ID NO: 12000 - protein, 124 aa, Artificial Sequence
  Description of Artificial Sequence: Synthetic polypeptide
QVQLVESGGGVVQPGRSRRLSCVGSGFIFSSYGMHWVRQAPGKGLEWVALIFYDGSNEYYVDSVKGRFTISRDNSKNTLYLQMNSLRAEDTAVYYCAREGYSQRYKYYFGMDVWGQGTTVTVSS

SEQ ID NO: 12001 - protein, 122 aa, Artificial Sequence
  Description of Artificial Sequence: Synthetic polypeptide
EVQLVESGGGLVQPGGSLRLSCAASGFPFSSYDMHWVRQATGKGLEWVSAIGTAGATYYPGSVKGRFTISRENAKNSLYLQMNSLRAGDTAVYYCARGDYVWGTYRPLFDYWGQGTLVTVSS

SEQ ID NO: 12002 - protein, 124 aa, Artificial Sequence
  Description of Artificial Sequence: Synthetic polypeptide
QVQLVESGGGVVQPGRSLRLSCAASGFTFSRYGIHWVRQAPGKGLEWVAVIWHDGSNKYYADSVKGRFTISRDNSKNTLYLQMTSLRAEDTAVYYCARDGLEIRDHYYYGMDVWGQGTTVTVSS

SEQ ID NO: 12003 - protein, 126 aa, Artificial Sequence
  Description of Artificial Sequence: Synthetic polypeptide
EVQLVESGGGLVQPGRSLRLSCAASGFTFDDYAMHWVRQVPGKGLEWVSGISWNSGSIGYADSVKGRFTISRDNAKNSLYLQMNSLRAEDTALYYCAKDIHDYGKDYYYYYGMDVWGQGTTVTVSS

SEQ ID NO: 12004 - protein, 118 aa, Artificial Sequence
  Description of Artificial Sequence: Synthetic polypeptide
QVQLVESGGGVVQPGRSLRLSCAASGFTFSAYAMHWVRQAPGKGLEWVAVIWYDGSNKNYADSVKGRFTVSRDNSKNTLYLEMNSLRAEDTAVYYCARDLMVGVTNYWGQGTLVTVST

SEQ ID NO: 12005 - protein, 119 aa, Artificial Sequence
  Description of Artificial Sequence: Synthetic polypeptide
QVQLQQWGAGLLKPAETLSLTCAVYGGSFSGNYWSWIRQSPGKGLEWIGEINHRGNSNYNPSLKSRGTISLDTSKNQLSLKLRSVTAADTAMYYCVRGGGDYYFGMDVWGQGTTVTVSS

SEQ ID NO: 12006 - protein, 119 aa, Artificial Sequence
  Description of Artificial Sequence: Synthetic polypeptide
QVQLQQWGAGLLKPSETLSLTCAVYGGSFSGYYWSWIRQSPGKGLEWIGEINHSGSTNYNPSLKSRVTISVDTSKNQFSLKLTSVTAADTAVYFCARGGGTYYYGMDVWGQGTTVTVSS

SEQ ID NO: 12007 - protein, 119 aa, Artificial Sequence
  Description of Artificial Sequence: Synthetic polypeptide
QVQLQQWGAGLLKPSETLSLTCAVYGGSFSGDYWSWIRQSPGKGLEWIGEINHSGSTNYNPSLKSRVTISIDTSKNQFSLKLSSVTAADTAVYYCARGGGDYYYGMDVWGLGTTVTVSS

SEQ ID NO: 12008 - protein, 129 aa, Artificial Sequence
  Description of Artificial Sequence: Synthetic polypeptide
  synthetic antibody VH sequence
QVQLLQSGAELKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSS

SEQ ID NO: 12009 - protein, 129 aa, Artificial Sequence
  Description of Artificial Sequence: Synthetic polypeptide
  synthetic antibody VH sequence
QVQLLQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVAYCSSSNCAKWPEYFQHWGQGTLVTVSS

SEQ ID NO: 12010 - protein, 129 aa, Artificial Sequence
  Description of Artificial Sequence: Synthetic polypeptide
  synthetic antibody VH sequence
QVQLLQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCSSSNCAKWPEYFQHWGQGTLVTVSS

SEQ ID NO: 12011 - protein, 129 aa, Artificial Sequence
  Description of Artificial Sequence: Synthetic polypeptide
  synthetic antibody VH sequence
QVQLLQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEYFQHWGQGTLVTVSS

SEQ ID NO: 12012 - protein, 129 aa, Artificial Sequence
  Description of Artificial Sequence: Synthetic polypeptide
  synthetic antibody VH sequence
QVQLLQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 12013 - protein, 140 aa, Artificial Sequence
  Description of Artificial Sequence: Synthetic polypeptide
MGFGLSWLFLVAILKGVQCQVQLVQSGAEVKKPGSSVKVSCKASGGTFSSYAISWVRQAPGQGLEWMGSIIPIFGTVNYAQKFQGRVTITADESTSTAYMELSSLRSEDTAVYYCARDPSVNLYWYFDLWGRGTLVTVSS

SEQ ID NO: 12014 - protein, 138 aa, Artificial Sequence
  Description of Artificial Sequence: Synthetic polypeptide
MGFGLSWLFLVAILKGVQCQVQLVQSGAEVKKPGSSVKVSCKASGGTFGSYAISWVRQAPGQGLEWMGSIIPIFGAANPAQKSQGRVTITADESTSTAYMELSSLRSEDTAVYYCAKMGRGKVAFDIWGQGTMVTVSS

SEQ ID NO: 12015 - protein, 142 aa, Artificial Sequence
  Description of Artificial Sequence: Synthetic polypeptide
MGFGLSWLFLVAILKGVQCQVQLVQSGAEVKKPGASVKVSCKASGYAFTSYGINWVRQAPGQGLEWMGWISAYNGNTYYAQKLRGRVTMTTDTSTSTAYMELRSLRSDDTAVYYCARDLGGYGSGSVPFDPWGQGTLVTVSS

SEQ ID NO: 12016 - protein, 124 aa, Mus musculus; identical to SEQ ID NO: 4955

SEQ ID NO: 12017 - protein, 120 aa, Mus musculus; identical to SEQ ID NO: 11956

SEQ ID NO: 12018 - protein, 120 aa, Mus musculus; identical to SEQ ID NO: 11957

SEQ ID NO: 12019 - protein, 122 aa, Mus musculus; identical to SEQ ID NO: 11961

SEQ ID NO: 12020 - protein, 118 aa, Mus musculus; identical to SEQ ID NO: 11965

SEQ ID NO: 12021 - protein, 122 aa, Mus musculus
RAEVQLQQSGTELVKPGASVILSCKASGYTFTSYWMQWVKQRPGQGLEWIGNINPSNGGTSFNEEFKSRATLTVDKSSSTAYMQLSSLTSEDSAVYYCARDGGLYDGYYFDFWGQGTTLTVS

SEQ ID NO: 12022 - protein, 116 aa, Mus musculus
  Ab 4385 VH
QVTLKESGAELMKPGASVKLSCKATGYTFTGYWIEWVKQRPGHGLEWIGEILPGSGSTNYNEKFKGEATFTADTSSNTAYMHLSSLTTEDSAIYYCARWGDGSFAYWGQGTLVTVS

SEQ ID NO: 12023 - protein, 120 aa, Mus musculus
RAEVQLQQSGPELVMPGASVKISCKASGYSFTSYYVHWVKQRPGQGLEWIGWIYPGSGHTKYNEKFKDKATLTADTSSSTAYMQLSSLTSEDSAVYYCARPPYYSNYADVWGTGTTVTVS

SEQ ID NO: 12024 - protein, 121 aa, Mus musculus
RAEVKLVESGPGLVKPSQSLSLTCSVTGYSITSGFYWTWIRQFPGNKLEWMGFISYDGSNNYNPSLKNRISITRDTSKNQFFLKLNSVTTEDTATYYCARGGGYYGNLFDYWGQGTTLTVS

SEQ ID NO: 12025 - protein, 119 aa, Mus musculus
RAEVQLKESGPGLVKPSQSLSLTCSVTGYSITSAYYWNWIRQFPGNKVEWMGYIGYDGRNTYNPSLKNRISITRDTSKNQFFLKLNSLTTEDTATYYCSREGDYGYSDYWGQGTTLTVS

SEQ ID NO: 12026 - protein, 122 aa, Mus musculus
RAEVQLQQSGPELVKPGASVKMSCKASGYTFTSYLLHWVKQKPGQGLEWIGYINPYNDGAKYNEKLKGKATLTSDKSSSTAYMEVSSLTSEDSAVYYCAREGDYVRYYGMDYWGQGTSVTVS

SEQ ID NO: 12027 - protein, 118 aa, Mus musculus
  Ab 4384 VH
QVQLQQPGTELVKPGASVKLSCKASGYTFTSHWMHWVKQRPGQGLEWIGNINPSNGGTNYNEKFKSRATLTVDKASSTAYMQLSSLTSEDSAVYYCARAYYDFSWFVYWGQGTLVTVS

SEQ ID NO: 12028 - protein, 121 aa, Artificial Sequence
  Description of Artificial Sequence: Synthetic polypeptide
  Synthetic Polynucleotide used for CDR-H3 of anti-HER2 antibody
EVQLVESGGGLVQPGGSLRLSCAASGFTLSGDWIHWVRQAPGKCLEWVGEISAAGGYTDYADSVKGRFTISADTSKNTAYLQMNSLRAEDTAVYYCARESRVSFEAAMDYWGQGTLVTVSS

SEQ ID NO: 12029 - protein, 117 aa, Artificial Sequence
  Description of Artificial Sequence: Synthetic polypeptide
  Synthetic (heavy chain variable region of AT-VH1)
EVKLVESGGGLVQPGGSLRLSCATSGFTFTDYYMSWVRQPPGKGLEWLGFIRNKANGYTTEYSASVKGRFTISRDNSKSTLYLQMNSLRAEDSATYYCARDNWFAYWGQGTLVTVSS

SEQ ID NO: 12030 - protein, 118 aa, Artificial Sequence
  Description of Artificial Sequence: Synthetic polypeptide
  synthetic anti-EphA3 antibody heavy chain V-H region
QVQLVQSGAEVKKPGTSVKVSCKASGYTFTGYWMNWVRQASGQGLEWMGDIYPGSGNTNYDEKFQGRVTMTRDTSISTAYMELSRLRSDDTAVYYCARSGVYEDFDSWGQGTTVTVSS

SEQ ID NO: 12031 - protein, 118 aa, Artificial Sequence
  Description of Artificial Sequence: Synthetic polypeptide
  synthetic anti-EphA3 antibody heavy chain V-H region
QVQLVQSGAEVKKPGASVKVSCKASGYTFTGYWMNWVRQAPGQGLEWMGDIYPGSGNTNYDEKFQGRVTMTRDTSISTAYMELSRLRSDDTAVYYCARSGYYEEFDSWGQGTTVTVSS

SEQ ID NO: 12032 - protein, 118 aa, Artificial Sequence
  Description of Artificial Sequence: Synthetic polypeptide
  synthetic anti-EphA3 antibody heavy chain V-H region
QVQLVQSGAEVKKPGTSVKVSCKASGYTFTGYWMNWVRQASGQGLEWMGDIYPGSGNTNYDEKFQGRVTMTRDTSISTAYMELSRLRSDDTAVYYCARSGYYEEFDSWGQGTTVTVSS

SEQ ID NO: 12033 - protein, 118 aa, Artificial Sequence
  Description of Artificial Sequence: Synthetic polypeptide
  synthetic anti-EphA3 antibody heavy chain V-H region
QVQLVQSGAELKKPGASVKVSCKTSGYTFTGYWMNWVRQAPGQGLEWMGDIYPGSGNTNYDEKFQGRVTMTRDTSISTAYMELSRLRSDDTAVYYCARSGYYEEFDSWGQGTTVTVSS

SEQ ID NO: 12034 - protein, 118 aa, Artificial Sequence
  Description of Artificial Sequence: Synthetic polypeptide
  synthetic anti-EphA3 antibody heavy chain V-H region
QVQLVQSGAEVKKPGASVKVSCKASGYTFTGYWMNWVRQAPGQGLEWMGDIYPGSGNTNYDEKFQGRVTMTRDTSISTAYMELSRLRSDDTAVYYCARGGYYEDFDSWGQGTTVTVSS

SEQ ID NO: 12035 - protein, 118 aa, Artificial Sequence
  Description of Artificial Sequence: Synthetic polypeptide
  synthetic anti-EphA3 antibody heavy chain V-H region
EVQLVQSGAEVKKPGESLRISCKGSGYTFTTYWISWVRQMPGQGLEWMGDIYPGSGNTNYAQKFQGRVTITADKSTSTAYMGLSSLRSEDTAVYYCARSGYYEDFDSWGQGTTVTVSS

SEQ ID NO: 12036 - protein, 118 aa, Artificial Sequence
  Description of Artificial Sequence: Synthetic polypeptide
  synthetic anti-EphA3 antibody heavy chain V-H region
EVQLVQSGAEVKKPGESLRISCKGSGYTFTTYWISWVRQMPGQGLEWMGDIYPGSGNTNYAQEFRGRVTITADESTSTAYVELSSLRSEDTAVYYCARSGYYEDFDSWGQGTTVTVSS

SEQ ID NO: 12037 - protein, 118 aa, Artificial Sequence
  Description of Artificial Sequence: Synthetic polypeptide
  synthetic anti-EphA3 antibody heavy chain V-H region
EVQLVQSGAEVKKPGESLRISCKGSGYTFTTYWISWVRQMPGQGLEWMGDIYPGSGNTNYAQKFLGRVTITADESTSTAYMELSSLRYDDTAVYYCARSGYYEDFDSWGQGTTVTVSS

SEQ ID NO: 12038 - protein, 118 aa, Artificial Sequence
  Description of Artificial Sequence: Synthetic polypeptide
  synthetic anti-EphA3 antibody heavy chain V-H region
EVKLEESGAELVKPGSSVKLSCKASGYNFTSYWINWVRLRPGQGLEWIGDIYPGSGNTNYDEKFKRKATLTVDTSSSTAYMQLSSLASEDTAVYYCARSGYYEDFDVWGQGTTVTVSS

SEQ ID NO: 12039 - protein, 118 aa, Artificial Sequence
  Description of Artificial Sequence: Synthetic polypeptide
  synthetic anti-EphA3 antibody heavy chain V-H region
EVKLEESGAELVKPGSSVKLSCKASGYNFTSYWINWVRLRPGQGLEWIGDIYPGSGNTNYDEKFKRKATLTVDTSSSTAYMQLSSLASEDTAVYYCARSGYYEDFDIWGQGTMVTVSS

SEQ ID NO: 12040 - protein, 118 aa, Artificial Sequence
  Description of Artificial Sequence: Synthetic polypeptide
  synthetic murine mIIIA4 and reference Fab FA4 Vh region
EVKLEESGAELVKPGSSVKLSCKASGYNFTSYWINWVRLRPGQGLEWIGDIYPGSGNTNYDEKFKRKATLTVDTSSSTAYMQLSSLASEDSALYYCTRSGYYEDFDSWGQGTTLIVSS

SEQ ID NO: 12041 - protein, 118 aa, Artificial Sequence
  Description of Artificial Sequence: Synthetic polypeptide
  synthetic optimized reference Fab FA106 Vh regio
EVKLEESGAELVKPGSSVKLSCKASGYNFTSYWINWVRLRPGQGLEWIGDIYPGSGNTNYDEKFKRKATLTVDTSSSTAYMQLSSLASEDTAVYYCARSGYYEDFDSWGQGTTVTVSS

SEQ ID NO: 12042 - protein, 119 aa, Mus musculus
EVQLQQSGPELVKPGTSVKISCKASGFTFTDYTMDWVKQSHGKSLEWIGDVNPNSGGSIYNQRFKGKASLTVDRSSRIVYMELRSLTFEDTAVYYCARNLGPSFYFDYWGQGTTLTVSS

SEQ ID NO: 12043 - protein, 129 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGPITIVRGVYYYFYGMDVWGQGTTVTVSS

SEQ ID NO: 12044 - protein, 121 aa, Homo sapiens
EVQLVESGGGLVKPGGSLRLSCAASGFTFSSYSMNWVRQAPRKGLEWVSSISSSSSYIYYADSVKGRFTISRDNAKNSLYLQMNSLRAEDTAVYYCARGGDGYNYYYFDYWGQGTLVTVSS

SEQ ID NO: 12045 - protein, 117 aa, Homo sapiens
EVQLVESGGGLVQPGGSLRLSCAASGFTFSSYWMHWVRQTPGKGLEWVANIKQDGSEKYYVDSVKGRFTISRDNAKNSLHLQMNSLRAEDTAAYYCASFRDYGMDVWGQGTTVTVSS

SEQ ID NO: 12046 - protein, 121 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGGDGYNYYYFDYWGQGTLVTVSS

SEQ ID NO: 12047 - protein, 121 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLSAEDTAVYSCARGGDGYNYYYFDYWGQGTLVTVSS

SEQ ID NO: 12048 - protein, 121 aa, Homo sapiens
EVQLVESGGGLVKPGGSLRLSCAASGFTFSSYTMNWVRQAPGKGLEWVSSISSSSSYIYYADSVKGRFTISRDNAKNSLYLQMNSLSAEDTAVYSCARGGDGYNYYYFDYWGQGTLVTVSS

SEQ ID NO: 12049 - protein, 123 aa, Homo sapiens
EVQLVESGGGLVQPGGSLRLSCTASGFPFSSYDMHWVRQATGKGLEWVSAIGTAGDTFYPGSVKGRFTISRENAKNSLYLQMNSLRAGDTAVYYCAREGYSSGRYFYYGMDVWGQGTTVTVSS

SEQ ID NO: 12050 - protein, 112 aa, Homo sapiens
DIVMTQTPLSLSVTPGQPASISCKSSQSLLHSDGKTYLYWYLQKPGQPPQPLIYEVSNRFSGVPDRFSGSGSGTDFTLKISRVEAEDVGIYYCMQSKQLPRTFGQGTKVEIK

SEQ ID NO: 12051 - protein, 120 aa, Artificial Sequence
  Description of Artificial Sequence: Synthetic polypeptide
  Heavy Chain Variable Region
  MOD_RES (57)..(57): Tyr or an amino acid having a side chain that is nonpolar and/or a side chain that is non-neutral and/or a side chain that is not large
  MOD_RES (59)..(59): Arg or an amino acid having a side chain that is nonpolar and/or is charge neutral or negative and/or is not large
EVQLVESGGGLVQPGGSLRLSCAASGFNIKDTYIHWVRQAPGKGLEWVARIYPTNGXTXYADSVKGRFTISADTSKNTAYLQMNSLRAEDTAVYYCSRWGGDGFYAMDYWGQGTLVTVSS

SEQ ID NO: 12052 - protein, 123 aa, Homo sapiens
QVQLVQSGAEVKQPGASVKVSCKASGGTFSSYAISWVRQAPGQGLEWMGGIIPIFGTANYAQKFQGRVTITADESTSTAYMELSSLRSEDTAVYYCATTTMVRGVIMYYFDYWGQGTLVTVSS

SEQ ID NO: 12053 - protein, 117 aa, Homo sapiens
EVQLVQSGAEVKKPGASVTVSCKPSGYAFTDYYIHWVRQAAGQGLEWMGWVDPRSGATVYAQNFQGRVTMTRDRSSSTVYMDLSRVTSDDTALYFCGRDNYGIFDYWGQGTLVTVSS

SEQ ID NO: 12054 - protein, 121 aa, Homo sapiens
QMQLVQSGADVKKPGASVRVSCKTSGYTFTSYDINWVRQAPGQGLEWMGWMNPDTGNTAYVQKFQGRVTVTRDTSINTVYMELSGLRSEDTAVYYCAKSGGSSSYDAFDIWGQGTMVTVSS

SEQ ID NO: 12055 - protein, 120 aa, Homo sapiens
VQLLESGAEVKKPGASMKVSCKASGYPFPSYGISWVRQAPGQGLEWMGWINPYNGETNSAQQLQGRVTMTTDTSASTAYMELRSLRADDTAVYYCARARTPIAAAWFDPWGQGTLVTVSS

SEQ ID NO: 12056 - protein, 121 aa, Homo sapiens
QVQLVESGGGLVQPGGSLRLACAASGFTFSNYEMNWVRQAPGKGLEWVATISDDSVYKYYADSVKGRFTISRDNSKALFYLQMDSLTFEDTAIYYCARDPGGDSLGYFQHWGQGTLVTVSS

SEQ ID NO: 12057 - protein, 118 aa, Homo sapiens
EVQLVESGGGLVKPGGSLRLSCAASGFTFSRYSMNWVRQAPGKGLEWVSSISSSSSYIFYADSVKGRFTISRDNAKNSLYLQVNSLGAEDTAVYYCARASSEDAFDIWGQGTMVTVSS

SEQ ID NO: 12058 - protein, 118 aa, Homo sapiens
QLVESGGGVVQPGGSLRLSCAASGFNFRAYGMHWVRQAPGKGLEWLAMMSSDGTRTYYADSVKGRFTISRDNSKNTLYVQMNSLRAEDTAVYYCARDRGSFSSSFDLWGQGTLVTVSS

SEQ ID NO: 12059 - protein, 123 aa, Homo sapiens
EVQLLESGGGLVQPGGSLRLSCAASGFTFSTYWMTWVRQAPGKGLEWVASMNQDGSEKYYVDSVKGRFTISRDNAKNSLYLQMNSLRDEDTALYYCAKAYSSSWLLSGGMDVWGQGTTVTVSS

SEQ ID NO: 12060 - protein, 119 aa, Homo sapiens
QVQLVQSGAEVKKPGASVKVSCKASGYTFTSHYGISWVRQAPGQGLEWMGSITPHNGKTNYVQMFQGRVTMTTDTSTRTVYMELRNLRSDDTAVYYCARDWNFADFDYWGQGTLVTVSS

SEQ ID NO: 12061 - protein, 119 aa, Homo sapiens
QVQLVESGGGLVKPGGSLRLSCAASGFTFSSYSMNWVRQAPGKGLEWVSSISSRSGYIYYADSVKGRFTISRDNAKNSLYLQMNSLRDEDTAVYYCVRDGGTVDAFDIWGQGTMVTVSS

SEQ ID NO: 12062 - protein, 123 aa, Homo sapiens
QVQLVQSGRGLVQPGRSLRLSCAASGFTFDEYAMHWVRHAPGKGLEWVAGMSWNGGGIGYADSVKGRFTISRDNSKNTLYLQMNSLRAEDTAVYYCAREGAGGSYPTDAFDIWGQGTTVTVSS

SEQ ID NO: 12063 - protein, 119 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAREAYAWGAFDIWGQGTMVTVSS

SEQ ID NO: 12064 - protein, 123 aa, Homo sapiens
QVQLQQSGPGLVQPSQTLSLTCDISGDSVSSTGAAWNWIRQSPSRGLEWLGRTYYRSKWYNDYALSVRSRITITPDTSKNQFSLQLNSVTPEDTAVYYCVRDGDVGLDAFDIWGQGTMVTVSS

SEQ ID NO: 12065 - protein, 120 aa, Homo sapiens
QVQLQQWGAGLLKSSETLSLSCAVYGGTFRDDHWSWIRQPPGKGLEWIGESHHTGRTIYNPSLRSRVTMSIDTSKNEFSLILRSVTAADTATYFCARGNNYVWGNQEDFWGQGTLVTVSS

SEQ ID NO: 12066 - protein, 117 aa, Homo sapiens
QLVQSGAEVRKPGASVKVSCKASGYTFADYYIHWVRQAPGQGLEWMGWINPNSGGADYAQKLQGRVTMTTDTSTSTAYMELRSLRSDDTAVYYCAREGYAWGAFDIWGQGTMVTVSS

SEQ ID NO: 12067 - protein, 120 aa, Homo sapiens
EVQLVQSGAEVRKPGASVKVSCKASQYTFTNYHIHWVRQVPGQGLEWMAMINPSNGNTNYGQRFQDRVTLTRDTSTSTAYMELSSLRSEDTAVYLCARDGLTFGDLLAYWGQGTLVTVSS

SEQ ID NO: 12068 - protein, 122 aa, Homo sapiens
QVQLVESGGGLVKPGGSLRLSCAASGFTFSSYSMNWVRQAPGKGLEWVSSISSSSSYIYYADSVKGRFTISRDNSKNTLYLQMNSLRDEDTAVYYCAREILTGYYPDAFDMWGQGTMVTVSS

SEQ ID NO: 12069 - protein, 118 aa, Homo sapiens
EVQLLESGGGLVKPGGSLRLSCAASGFTFSSYSMNWVRQAPGKGLEWVSSISSSSSYIYYADSVKGRFTISRDNAKNSLYLQMNSLRAEDTAVYYCARGFGEDLFDYWGQGTLVTVSS

SEQ ID NO: 12070 - protein, 123 aa, Homo sapiens
QVQLVESGGGLVQPGGSLRLSCVASGFTFSSYWMSWVRQAPGKGLEWVAYINLDGSEKDYVDSVKGRFTISRDNAKNSLYLQMNSLRAEDTALYYCAKAYSSSWLLSGGMDVWGQGTTVTVSS

SEQ ID NO: 12071 - protein, 122 aa, Homo sapiens
QVQLVESGGGLVKPGGSLRLSCAASGFTSSSYVLNWVRQAPGKGLEWVSSISSRGSYIYYADSVKGRFTISRDNAKNSLYLQMNSLRAEDTAVYYCARERAGFSPVNAFDIWGQGTMVTVSS

SEQ ID NO: 12072 - protein, 119 aa, Homo sapiens
  MOD_RES (19)..(20): Any naturally occurring amino acid
QVQLQQWGAGLLKPSETLXXTCAVYGGSFSGYYWSWIRQPPGKGLEWIGEINHSGSTNYNPSLKSRVTISVDTSKNQFSLQLNSVTPEDTAVYYCVRDDGMGLDALDIWGQGTMVTVSS

SEQ ID NO: 12073 - protein, 115 aa, Homo sapiens
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCAGGGYYSYWGQGTLVTVSS

SEQ ID NO: 12074 - protein, 126 aa, Homo sapiens
QVQLVESGGGLIQPGGSVKLSCAASGFTVSSNYMSWVRQAPGKGLEWVAVISYDGSFEYYGESVKGRFTISRDNAKNTLYLQMSSLRPEDTAVYYCAKDTPYYYDSSGQSGDYFDHWGQGALVTVS

SEQ ID NO: 12075 - protein, 117 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDFGVGAVDYWGQGTLVTVSS

SEQ ID NO: 12076 - protein, 121 aa, Homo sapiens
QLQLQESGPGLVKPSQTLSLTCTVSGGSINSAGYYWTWIRQHPGKGLEWIGSIYYSGSTYYNPSLKSRVSMSQDTSKNQFSLKLSSLTAADTAVYYCAREVGVVPEYMDVWGQGTTVTVSS

SEQ ID NO: 12077 - protein, 117 aa, Homo sapiens
QVQLVESGGGLVQPGRSLRLSCAASGFTFSSYGMHWVRQAPGKGLEWVGFIRSETYGGTTQTAASVKGRFSISRDDSQGIAYLQMDSLKTEDTAVYFCARSGRGDFWGQGTLVTVSS

SEQ ID NO: 12078 - protein, 126 aa, Homo sapiens
  MOD_RES (19)..(19): Any naturally occurring amino acid
QVQLQESGGGVVQPGRSLXLSCAASGFTFSSYAMHWVRQAPGKGLEWVAVISYDGSNKYYADSVKGRFTISRDNSKNTLYLQMNSLRAEDTAVYYCARDRWDVASTVEATDGMDVWGQGTTVTVSS

SEQ ID NO: 12079 - protein, 119 aa, Artificial Sequence [sequence omitted]

SEQ ID NO: 12080 - protein, 118 aa, Artificial Sequence
  Description of Artificial Sequence: Synthetic polypeptide
EVQLLESGGGLVQPGGSLRLSCAASGFTFSAYNMRWVRQAPGKGLEWVSVIYPSGGATRYADSVKGRFTISRDNSKNTLYLQMNSLRAEDTAVYYCARGYYYYGMDVWGQGTLVTVSS

SEQ ID NO: 12081 - protein, 122 aa, Artificial Sequence
  Description of Artificial Sequence: Synthetic polypeptide
EVQLLESGGGLVQPGGSLRLSCAASGFTFSAYGMGWVRQAPGKGLEWVSYISPSGGHTKYADSVKGRFTISRDNSKNTLYLQMNSLRAEDTAVYYCAKVLETGLLVDAFDIWGQGTMVTVSS

SEQ ID NO: 12082 - protein, 118 aa, Artificial Sequence
  Description of Artificial Sequence: Synthetic polypeptide
EVQLLESGGGLVQPGGSLRLSCAASGFTFSWYGMGWVRQAPGKGLEWVSYISPSGGITVYADSVKGRFTISRDNSKNTLYLQMNSLRAEDTAVYYCARLNYYYGLDVWGQGTTVTVSS

SEQ ID NO: 12083 - protein, 119 aa, Artificial Sequence
  Description of Artificial Sequence: Synthetic polypeptide
EVQLLESGGGLVQPGGSLRLSCAASGFTFSRYGMWWVRQAPGKGLEWVSYIGSSGGPTYYVDSVKGRFTISRDNSKNTLYLQMNSLRAEDTAVYYCAGGRGTPYYFDSWGQGTLVTVSS

SEQ ID NO: 12084 - protein, 120 aa, Artificial Sequence
  Description of Artificial Sequence: Synthetic polypeptide
  Synthetic Construct
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGWGFYAFALWGQGTLVTVSS

SEQ ID NO: 12085 - protein, 120 aa, Artificial Sequence
  Description of Artificial Sequence: Synthetic polypeptide
  Synthetic Construct
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWNAKGFYSFVHWGQGTLVTVSS

SEQ ID NO: 12086 - protein, 107 aa, Artificial Sequence
  Description of Artificial Sequence: Synthetic polypeptide
  Synthetic Construct
DIQMTQSPSSLSASVGDRVTITCRASQDVNTAVAWYQQKPGKAPKLLIYSASFLYSGVPSRFSGSRSGTDFTLTISSLQPEDFATYYCQQHYQTPASFGQGTKVEIK

SEQ ID NO: 12087 - protein, 120 aa, Artificial Sequence
  Description of Artificial Sequence: Synthetic polypeptide
  Synthetic Construct
EVQLVESGGGLVQPGGSLRLSCAASGFNIKDTYIHWVRQARGKGLEWVARIYPTNGYTRYADSVKGRFTISADTSKNTAYLQMNSLRAEDTAVYYCSRWGGWGFYAFALWGQGTLVTVSS

SEQ ID NO: 12088 - protein, 121 aa, Artificial Sequence
  Description of Artificial Sequence: Synthetic polypeptide
  VH synthetic peptide
QVQLVQSGAEVKKPGASVKVSCKASGYTFTDYYLNWVRQAPGQGLEWMGEIDPGSDSIYYNENLEGRVTITADTSTSTAYMELSSLRSEDTAVYYCARYGYSRYDVRFVYWGQGTLVTVSS

SEQ ID NO: 12089 - protein, 121 aa, Artificial Sequence
  Description of Artificial Sequence: Synthetic polypeptide
  VH synthetic peptide
QVQLVQSGAEVARPGASVKVSCKASGYTFTDYYLNWVRQRSGQGLEWIGEIDPGSDSIYYNENLEGRVTITADTSTSTAYMELSSLRSEDTAVYFCARYGYSRYDVRFVYWGQGTLVTVSS

SEQ ID NO: 12090 - protein, 121 aa, Mus musculus
QVQLQQSGAEVARPGASVKLSCKASGYTFTDYYLNWVKQRSGQGLEWIGEIDPGSDSIYYNENLEGRATLTADKSSSTAYMQLNSLTSEDSAVYFCARYGYSRYDVRFVYWGQGTLVTVST

SEQ ID NO: 12091 - protein, 122 aa, Rattus norvegicus
EVQLVESGGGLVQPGRSLKLSCVASGFRFNDFWMTWIRQAPGKGLEWVASITYTGDNTYYAGSVKGRITISRDNAKSTLYLQMNSLRSEDTATYYCTRDDYGGYSPYYMDAWGQGTSVTVSS

SEQ ID NO: 12092 - protein, 118 aa, Rattus norvegicus
QVKLLQSGAELVKPGASVKLSCKTSGFTFSTSYMSWLKQVPGPSIEWIGWIYAGDGGTKYNQKFKGKATLTVDKSSSTAYMDLSSLTSEDAAVYFCATDGYGDWFAYWGQGTLVTVSS

SEQ ID NO: 12093 - protein, 118 aa, Rattus norvegicus
QVKLLQSGAELVKPGASVKLSCKTSGFTFSTSYMSWLKQVPGPSTEWIGWIYAGDGGTKYNQKFKGKATLTVDKFSSTAYMDLSSLTSEDAAVYFCATDGYGDWFTYWGQGTLVTVSS

SEQ ID NO: 12094 - protein, 120 aa, Mus musculus
EVQLQQSGPELVKPGASVKISCKASGYTFTDYNMDWVKQSHGKSLEWIGYIYPNNGGTGYNQKFKSKATLTVDKSSSTAYMELHSLTSEDSAVYYCATYGHYYGYMFAYWGQGTLVTVSA

SEQ ID NO: 12095 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVRQAPGQGLEWMGYIYPNNGGTGYNQKFKSKVTITVDTSTSTAYMELHSLRSEDTAVYYCATYGHYYGYMFAYWGQGTLVTVSSASTKG

SEQ ID NO: 12096 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVRQAPGQGLEWMGYIYPNNGGTGYNQKFKSRVTITADTSTSTAYMELSSLRSEDTAVYYCARYGHYYGYMFAYWGQGTLVTVSSASTKG

SEQ ID NO: 12097 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVKQSPGQGLEWMGYIYPNNGGTGYNQKFKSKVTITVDTSTSTAYMELHSLRSEDTAVYYCATYGHYYGYMFAYWGQGTLVTVSSASTKG

SEQ ID NO: 12098 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVKQSPGKSLEWMGYIYPNNGGTGYNQKFKSKVTITVDTSTSTAYMELHSLRSEDTAVYYCATYGHYYGYMFAYWGQGTLVTVSSASTKG

SEQ ID NO: 12099 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVRQAPGQGLEWMGYIYPNNGGTGYNQKFKSKATLTVDTSTSTAYMELHSLRSEDTAVYYCATYGHYYGYMFAYWGQGTLVTVSSASTKG

SEQ ID NO: 12100 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVKQSPGKSLEWMGYIYPNNGGTGYNQKFKSKATLTVDTSTSTAYMELHSLRSEDTAVYYCATYGHYYGYMFAYWGQGTLVTVSSASTKG

SEQ ID NO: 12101 - protein, 125 aa, Artificial Sequence
  Description of Artificial Sequence: Synthetic polypeptide
  Amino Acid Sequence of Antibody Heavy Chain Variable Region
EVQLVQSGAEVKKPGASVKVSCKASGYTFTDYNMDWVKQSPGQGLEWMGYIYPNNGGTGYNQKFKSKATLTVDTSTSTAYMELHSLRSEDTAVYYCATYGHYYGYMFAYWGQGTLVTVSSASTKG

SEQ ID NO: 12102 - protein, 141 aa, Mus musculus
MEWIWIFLFILSGTAGVHSQVQLQQSGTELARPGASVKLSCKASGYTFRTYGITWVKQRTGQGLEWIGEIFPGSGNTYYNEKFKGKASLTADKSSSTAYMQLSSLTSEDSAVYFCARESFSDGYYGYFDYWGQGTTLTVSS

SEQ ID NO: 12103 - protein, 122 aa, Artificial Sequence
  Description of Artificial Sequence: Synthetic polypeptide
  Synthetic construct
QVQLVQSGAEVKKPGASVKVSCKASGYTFTTYGITWVRQAPGQGLEWMGEIFPGSGNTYYNEKFKGRVTITADKSTSTAYMELSSLRSEDTAVYYCARESFSDGYYGYFDYWGQGTLVTVSS

SEQ ID NO: 12104 - protein, 116 aa, Mus musculus
  Variable Region of Heavy Chain(35-1)
EVQLQQSGPELVKPRASVKISCKASGYSFSGYYMHWVKQSPEKSLEWIGEINPSTGGITYNQKFKAKATLTVDRSSSTAYMQLKSLTSEDSAVYYCTRITWAFAYWGQGTLVTVSA

SEQ ID NO: 12105 - protein, 117 aa, Mus musculus
  Variable Region of Heavy Chain(292)
EVQLQQSGPELVKPGASVKISCKASGYSFTGYYMHWVKQSPEKSLEWIGEINPSTGGTTYNQKFKAKATLTLDKSSSTAYMQLKSLTSEDSAVYYCAKSPYWDGAYWGQGTLVTVSA

SEQ ID NO: 12106 - protein, 116 aa, Artificial Sequence
  Description of Artificial Sequence: Synthetic polypeptide
  Synthetic Humanized Variable Region of Heavy Chain (35-1)
QVQLVQSGAEVVKPGSSVKVSCKASGYSFSGYYMHWVKQAPGQGLEWIGEINPSTGGITYNQKFKAKATLTVDRSTSTAYMELKSLTSEDTAVYYCTRITWAFAYWGQGTTVTVSS

SEQ ID NO: 12107 - protein, 120 aa, Homo sapiens
QVQLVQSGAEVKKPGASVKVSCKASGYTFTSYGISWVRQAPGQGLEWMGWISASNGNTNYAQKLQDRVTMTTDTSTSTAYMELRSLRSDDTAVYYCAREDNWNYGFFDYWGQGTLVTVSS

SEQ ID NO: 12108 - protein, 117 aa, Homo sapiens
QVHLVQSGAEVKKPGASVKVSCKVSGYTFTGHYMHWVRQAPGQGLEWMGWINPNSGGTNCAQKFQGRVTMTRDTSISTAYMELSRLRSDDTAVYYCARSIAVALDYWGQGTLVTVSS

SEQ ID NO: 12109 - protein, 117 aa, Homo sapiens
QVQLVQSGAEVKKPGASVKVSCKASGYTFTGYYMHWVRQAPGQGLEWMGWINPNSGGTNHTQKFQGRVTMTRDTSISTAYMELSRLRSDDTAVYYCARSIAVALDYWGQGTLVTVSS

SEQ ID NO: 12110 - protein, 122 aa, Homo sapiens
QVQLVQSGAEVRKPGASVKVSCKVSGYTLTELSMHWVRQAPGKGLEWMGSFDPEDGETIYAQKFQGRVTMLEDTSTDTAYMELSSLRSEDTAVYYCATEGDGGYYYYGMDVWGQGTTVTVSS

SEQ ID NO: 12111 - protein, 122 aa, Homo sapiens
QVTLKESGPVLVKPTETLTLTCTVSGFSLSNARMGVSWIRQPPGKALEWLAHIFSNDEKSYSTSLKSRLTISKDTSKSQVVLTMTNMDPVDTATYYCARMYSSGWYGVFDYWGQGTLVTVSS

SEQ ID NO: 12112 - protein, 123 aa, Homo sapiens
QVTLKESGPVLVKPTETLTLTCTVSGFSLSNARMGVSWIRQPPGKALEWLVLIFSNDEKSYSTSLKSRLTISKDTSKSQVVLTMTNMDPVDTATYYCARVYSSGWSFYGMDVWGQGTTVTVSS

SEQ ID NO: 12113 - protein, 118 aa, Homo sapiens
QITLKESGPTLVKPTQTLTLTCTFSGFSLSTGGVGVGWIRQPPGKALEWLALIYWNDDKRYSPSLKSRLTITKDTSKNQVVLTMTNMDPVDTATYYCAHRRELPFDYWGQGTLVTVSS

SEQ ID NO: 12114 - protein, 118 aa, Homo sapiens
QITLKESGPTLVKPTQTLTLTCTFSGFSLSTGGVGVGWIRQPPGKALEWLALIYWNDDKRYSPSLKSRLTITKDTSKTQVVLTVTDMDPVDTATYYCAHRNWTPFDYWGQGTLVTVSS

SEQ ID NO: 12115 - protein, 118 aa, Homo sapiens
QITLKESGPTLVKPTQTLTLTCTFSGFSLNTGGVGVGWIRQPPGKALEWLALIYWNDDKRYSPSLKSRLTITKDTSKNQVVLTMTNMDPVDTATYYCAHRLELPFDYWGQGTLVTVSS

SEQ ID NO: 12116 - protein, 118 aa, Homo sapiens
QITLKESGPTLVKPTQTLTLTCTFSGFSLSTGGVGVGWIRQPPGKALEWLALIYWNDDKRYSPSLKSRLTITKDTSKNQVVLTMTNLDPVDTATYYCAHRREVPFDYWGQGTLVTVSS

SEQ ID NO: 12117 - protein, 118 aa, Homo sapiens
QITLKESGPTLVKPTQTLTLTCTFSGFSLSTGGVGVGWIRQPPGKALEWLALIYWNVEKRYSPSLRSRLTITKATSKNQVVLTMTNMDPVDTATYYCAHRHTNPFEYWGQGTLVTVSS

SEQ ID NO: 12118 - protein, 118 aa, Homo sapiens
QITLKESGPTLVKPTQTLTLTCTFSGFSLSTGGVGVGWIRQPPGKALEWLALIYWNDDKRYSPSLKSRLTITKDTSKNQVVLTMTNMDPVDTATYYCAHRGELPFDYWGQGTLVTVSS

SEQ ID NO: 12119 - protein, 121 aa, Homo sapiens
EVQLVESGGGLVKPGGSLRLSCAASGFPFSRYSMNWVRQAPGKGLEWVSAISSSSSYIYYADSVKGRFTISRDNAKNSLYLQMNSLRAEDTAVYYCARDRVGATPDAFDIWGQGTMVTVSS

SEQ ID NO: 12120 - protein, 128 aa, Homo sapiens
EVQLLESGGGLVQPGGSLRLSCAASGFTFSSYAMNWVRQAPGKGLEWVSAISGSGGSTYYADSVKGRFTISRDNSKNTLYLQMNSLRAEDTAVYYCAKEGIAVAGTAEYYYYYAMDVWGQGTTVTVSS

SEQ ID NO: 12121 - protein, 125 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGIAARDSYYYYAMDVWGQGTTVTVSS

SEQ ID NO: 12122 - protein, 125 aa, Homo sapiens
EVQLLESGGGLVQPGGSLRLSCTASGFTFSSYAMSWVRQAPGKGLEWVSAISGSGGSTYYADSVKGRFTISRDNSKNTLYLQMNSLRAEDTAEYYCAKEGIAGRDSYYYYGMDVWGQGTTVTVSS

SEQ ID NO: 12123 - protein, 123 aa, Homo sapiens
QVQLVESGGGVVQPGRSLRLSCAASGFTFSSYGMHWVRQAPGKGLEWVAFISDDGSTKYYADSVKGRFTISRDNSMNTLYLQMNSLRAEDTAVYYCARSYYDSSGYYYGFDYWGQGTLVTVSS

SEQ ID NO: 12124 - protein, 114 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARNVIDYWGQGTLVTVSS

SEQ ID NO: 12125 - protein, 120 aa, Homo sapiens
QVQLVESGGGVVQPGRSLRLSCAASGFTFSSYDMHWVRQAPGKGLEWVAVIWYDGSIKYYADSVKGRFTISRDNSKNTLYLQMNSLRAEDTAVYYCARGGATGAEYFQHWGQGTLVTVSS

SEQ ID NO: 12126 - protein, 118 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCVLLWFGETFDYWGQGSLVTVSP

SEQ ID NO: 12127 - protein, 115 aa, Homo sapiens
QVQLVESGGGVVQPGRSLRLSCAASGFTFSSYGMHWVRQAPGKGLEWVAVIWSDGSNKYYADSVKGRFTISRDNSKNTLYLQMNSLRAEDTAVYYCARNLPFDYWGQGTLVTVSS

SEQ ID NO: 12128 - protein, 123 aa, Homo sapiens
QVQLVESGGGVVQPGRSLRLSCAASGFTFSSYGMHWVRQAPGKGLEWVAVIWDDGSNQYYTDSVKGRFTVSRDNSKNTLFLQMNSLRAEDTAVYYCARSHYGGDYDYYGMDVWGQGTTVTVSS

SEQ ID NO: 12129 - protein, 120 aa, Homo sapiens
QVQLVESGGGVVQPGRSLRLSCAASGFTFSSYGMHWVRQAPGKGLEWVAVIWYDGSNKRYVDSVKGRFTISRDNSKNTLYLQMNSLRAEDTAVYYCARDGWQQQAPFDYWGQGTLVTVSS

SEQ ID NO: 12130 - protein, 118 aa, Homo sapiens
QVQLVESGGGVVQPGRSLRLSCAASGFTFRSHGMHWVRQAPGKGLEWVAVIWYDGSNKNYADSVRGRFTISRDNSKNTLDLQMNSLRAEDTAVYYCARWGISAPFDCWGQGTLVTVSS

SEQ ID NO: 12131 - protein, 115 aa, Homo sapiens
EVQLVESGGGLVQPGGSLRLSCAASGFTFSAYSMNWVRQAPGKGLEWVSYISSSGRTIYYADSVKGRFTISRDNAKNSLFLQMNSLRDEDTAVYYCALWAPFDYWGQGTLVTVSS

SEQ ID NO: 12132 - protein, 125 aa, Homo sapiens
EVQLVESGGGLVQPGGSLRLSCAASGFTFSSYSMNWVRQAPGKGLEWVSHISSSSRTIYYADSVKGRFTISRDNAKNSVYLQMNSLRDEDTAVYYCARDGYNWNGGGNYYGMDVWGQGTTVTVSS

SEQ ID NO: 12133 - protein, 125 aa, Homo sapiens
EVQLVESGGGLVQPGGSLRLSCAASGFTFSSYSMNWVRQAPGKGLEWVSHISRSSRTIYYADSVKGRFTISRDNAKNSLYLQMNSLRDEDTAVYYCARDGYNWNNGGYYYGMDVWGQGTTVTVSS

SEQ ID NO: 12134 - protein, 118 aa, Homo sapiens
QVQLQESGPGLVKPSQTLSLTCTVSGGSVSSGGYYWSWIRQHPGKGLEWIGYIHSSGSTYYNPSLKSRVTISVDTSKNQFSLNLSSVTAADTAVYYCARGPYYGMDVWGQGTTVTVSS

SEQ ID NO: 12135 - protein, 127 aa, Homo sapiens
QVQLQESGPGLVKPSQTLSLTCTVSGGSISRGGYYWSWIRQHPGKGLEWIGYIYHSGSTYYNPSLKSRVNMSVDTSKNQFSLKLSSVTAADTAVYYCARALRGIVLMVYVLGALDIWGQGTKVTVSS

SEQ ID NO: 12136 - protein, 127 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDETVVRGLIRYCYGMDVWGQGTTVTVSS

SEQ ID NO: 12137 - protein, 122 aa, Homo sapiens
QVQLQESGPGLVKPSQTLSLNCTVSGGSISSGGYYWSWIRQHPGKGLEWIGYIHYSGSTYYNPSLKSRITISADTSKNQFSLKLNSVTAADTAVYYCARDRGGGDYGRMDVWGQGTTVTVSS

SEQ ID NO: 12138 - protein, 119 aa, Homo sapiens
QVQLQESGPGLVKPSQTLSLTCTVSGGSISSGGYYWSWIRQHPGKGLEWIGYIHSSGSTYYNPSLKSRITKSVDTSKNQFSLKLSSVTAADTAVYYCARSNNYGCFALWGRGTLVTVSS

SEQ ID NO: 12139 - protein, 133 aa, Homo sapiens
QVQLQESGPGLVKPSQTLSLTCTVSGGSISSGGYYWSWIRQHPGKGLEWIGYIHYSGSTYYNPSLKSRVTISVDTSKNQFSLKLSSVTAADTAVYYCASGYNYGLYYYDSSGYPSYYYGMDVWGQGTTVTVSS

SEQ ID NO: 12140 - protein, 125 aa, Homo sapiens
QVQLQESGPGLVKPSQTLSLTCTVSGGSISSGDYYWNWVRQHPGKGLEWIGYIYYSGGTYYNPSLKSRVTISVDTSKNQFSLKLFSVTAADTAVYFCARTYYDILTGYPFYFDYWGQGTLVTVSS

SEQ ID NO: 12141 - protein, 120 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWYWFDPWGQGTLVTVSS

SEQ ID NO: 12142 - protein, 120 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGYSSSWFWFDPWGQGTLVTVSS

SEQ ID NO: 12143 - protein, 123 aa, Homo sapiens
QVQLQESGPGLVKPSETLSLTCTVSGGSISSYYWSWIRQPAGKGLEWIGRIYTSGTTNYNPSLKSRVTMSVDTSKNQFSLKLSSVTAADTAVYYCARDGYSYGHYYYYGMDVWGQGTTVTVSS

SEQ ID NO: 12144 - protein, 126 aa, Homo sapiens
QVQLQESGPGLVKPSETLSLTCTVSGGSVSSGGSYWSWIRQPPGKGLEWIGYIYYSGSTNYNPSLKSRVTISIVTSRNQFSLKLSSVTAADTAVYYCARSALRYFDWLFSDVSDIWGQGTMVTVSS

SEQ ID NO: 12145 - protein, 120 aa, Homo sapiens
EVQLVQSGAELKKPGESLKISCKGSGYRFTSYWIGWVRQMPGKGLEWMGIIYPDDSDTRYSPSFQGQVTISADKSISTAYLQWSSLKASDTAMYYCARQKSYGYSYFDYWGQGTLVTVSS

SEQ ID NO: 12146 - protein, 121 aa, Homo sapiens
EVQLVQSGAEVKKPGESLKISCKGSGYSFTSYWIGWVRQMPGKGLEWMGIIYPDDSDARYSPSFQGQVTISADKSINTAYLQWSSLKASDTAMYYCARQGYGSGWGYFDYWGQGTLVTVSS

SEQ ID NO: 12147 - protein, 127 aa, Homo sapiens
EVQLVQSGAEVKKPGESLKISCKGSGYSFTSYWIGWVRQMPGKGLEWMGIIYPGDSDIRYSPSFQGQVTISADKSISTAYLQWSSLKASDTAMYYCARQGLAVAGTSYYYYYGMDVWGQGTTVTVSS

SEQ ID NO: 12148 - protein, 125 aa, Homo sapiens
QVQLQQSGPGLVKPSQTLSLTCAISGDSVSSYSAAWNWIRQSPSRGLEWLGRTYCRSKWYNDYAVSVKSRITINPDTSKNQFSLQLNSVTPEDTAVYYCARDRAVAGYYYGMDVWGQGTTVTVSS

SEQ ID NO: 12149 - protein, 121 aa, Artificial Sequence
  Description of Artificial Sequence: Synthetic polypeptide
EVQLVESGGGLVQPGGSLRLSCAASGFTFTGNWIHWVRQAPGKGLEWVGEISPSGGYTDYADSVKGRFTISADTSKNTAYLQMNSLRAEDTAVYYCARESRVSYEAAMDYWGQGTLVTVSS

SEQ ID NO: 12150 - protein, 121 aa, Artificial Sequence
  Description of Artificial Sequence: Synthetic polypeptide
EVQLVESGGGLVQPGGSLRLSCAASGFTFSGDWIHWVRQAPGKGLEWVGEISPAGAYTDYADSVKGRFTISADTSKNTAYLQMNSLRAEDTAVYYCAREAKVSFEAAMDYWGQGTLVTVSS

SEQ ID NO: 12151 - protein, 121 aa, Artificial Sequence
  Description of Artificial Sequence: Synthetic polypeptide
EVQLVESGGGLVQPGGSLRLSCAASGFTFTGDWIHWVRQAPGKGLEWVGEISPAGAYTDYADSVKGRFTISADTSKNTAYLQMNSLRAEDTAVYYCAREAKVSFEAAMDYWGQGTLVTVSS

SEQ ID NO: 12152 - protein, 121 aa, Artificial Sequence
  Description of Artificial Sequence: Synthetic polypeptide
EVQLVESGGGLVQPGGSLRLSCAASGFTLSGDWIHWVRQAPGKGLEWLGEISAAGGYTDYADSVKGRFTISADTSKNTAYLQMNSLRAEDTAVYYCARESKVSFEAAMDYWGQGTLVTVSS

SEQ ID NO: 12153 - protein, 121 aa, Artificial Sequence
  Description of Artificial Sequence: Synthetic polypeptide
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESKVSFEAAMDYWGQGTLVTVSS

SEQ ID NO: 12154 - protein, 114 aa, Artificial Sequence
  Description of Artificial Sequence: Synthetic polypeptide
DIQMTQSPSSLSASVGDRVTITCRASQALGDSENGYADVAWYQQKPGKAPKLLIYEGSSLYSGVPSRFSGSGSGTDFTLTISSLQPEDFATYYCQQAAPSPYTFGQGTKVEIKR

SEQ ID NO: 12155 - protein, 114 aa, Artificial Sequence
  Description of Artificial Sequence: Synthetic polypeptide
DIQMTQSPSSLSASVGDRVTITCRASQSLLASHDGTPWVAWYQQKPGKAPKLLIYDASYLYSGVPSRFSGSGSGTDFTLTISSLQPEDFATYYCQQSTFAPYTFGQGTKVEIKR

SEQ ID NO: 12156 - protein, 108 aa, Artificial Sequence
  Description of Artificial Sequence: Synthetic polypeptide
DIQMTQSPSSLSASVGDRVTITCRASQEIFPDVAWYQQKPGKAPKLLIYSASSLYSGVPSRFSGSGSGTDFTLTISSLQPEDFATYYCQQAAPTPYTFGQGTKVEIKR

SEQ ID NO: 12157 - protein, 108 aa, Artificial Sequence
  Description of Artificial Sequence: Synthetic polypeptide
DIQMTQSPSSLSASVGDRVTITCRASQAIASDVAWYQQKPGKAPKLLIYSASFLYSGVPSRFSGSGSGTDFTLTISSLQPEDFATYYCQQSEPEPYTFGQGTKVEIKR

SEQ ID NO: 12158 - protein, 108 aa, Artificial Sequence
  Description of Artificial Sequence: Synthetic polypeptide
DIQMTQSPSSLSASVGDRVTITCRASQDVGSDLAWYQQKPGKAPKLLIYSASYLYSGVPSRFSGSGSGTDFTLTISSLQPEDFATYYCQQSDPEPYTFGQGTKVEIKR

SEQ ID NO: 12159 - protein, 108 aa, Artificial Sequence
  Description of Artificial Sequence: Synthetic polypeptide
DIQMTQSPSSLSASVGDRVTITCRASQNIASDVAWYQQKPGKAPKLLIYSASSLYSGVPSRFSGSGSGTDFTLTISSLQPEDFATYYCQQSDPEPYTFGQGTKVEIKR

SEQ ID NO: 12160 - protein, 115 aa, Mus musculus
EVQLQQSGADLVKPGASVKLSCTTSGFNIKDIFIHWVKERPEQGLEWIGRIDPANDNPKYDPKFQGKATISADTSSNTAYLRLSSLTSEDTAVYYCAGGPAYFDYWGQGTTLTVS

SEQ ID NO: 12161 - protein, 119 aa, Artificial Sequence; identical to SEQ ID NO: 12042
  Description of Artificial Sequence: Synthetic polypeptide

SEQ ID NO: 12162 - protein, 119 aa, Artificial Sequence [sequence omitted]

SEQ ID NO: 12163 - protein, 122 aa, Homo sapiens
EVQLVQSGAEVKKPGESLKISCKASGYSFHFYWIGWVRQMPGKGLEWMGSIYPGDSDTRYRPSFQGQVTISADKSISTAYLQWTSLKASDTAIYYCARQRGDYYYFYGMDVWGQGTTVTVSS

SEQ ID NO: 12164 - protein, 119 aa, Homo sapiens
EVQLLESGGGLVQPGGSLRLSCAASGFTFSNYALIWVRQAPGKGLEWVSIIRGGAGSTYYADSVKGRFTISRDNSKNTLYLQMNSLRAEDTAVYYCAKARIWGPLFDYWGQGTLVTVSS

SEQ ID NO: 12165 - protein, 122 aa, Homo sapiens
QVQLVQSGAEVKKPGASVRVPCKASGYTFTRYGISWVRQAPGQGLEWMGWISAYNGKTYYAQKLQGRVTMTTDTSTSTAYMELRSLRSDDTAVYYCARSPLLWFEELYFDYWGQGTLVTVSS

SEQ ID NO: 12166 - protein, 122 aa, Homo sapiens
EVQLVQSGAEVKKPGESLKISCKGSGYRFTSYWIGWVRQMPGKGLEWMGSIYPGDSYTRNSPSFQGQVTISADKSIATAYLQWNSLKASDTAMYYCARHAGDFYYFDGLDVWGQGTTVTVSS

SEQ ID NO: 12167 - protein, 124 aa, Homo sapiens
EVQLVQSGAEVKKPGESLKISCKGSGYSFTRYWIGWVRQMPGKGLEWMGIIYPGDSDTRYSPSFQGQVTISADKSISTAYLQWSSLKASDTAMYYCARLTGDRGFDYYSGMDVWGQGTTVTVSS

SEQ ID NO: 12168 - protein, 119 aa, Homo sapiens
QVQLVQSGAEVKKPGSSVKVSCKASGGTFSSYGISWVRQAPGPGLEWMGRIIPILGIANYAQKFQGRVTITADKSTNTAYMELSSLRSEDTAVYYCARDQEYSSNWYYWGQGTLVTVSS

SEQ ID NO: 12169 - protein, 122 aa, Homo sapiens
EVQLVQSGAEVKKPGESLKISCKGSGYSFTSYWIGWVRQMPGKGLEWMGSIYPGDSHTRYRPSFQGQVTISADKSISTAYLQWSSLKASDTAMYYCARQKGDFYYFFGLDVWGQGTAITVSS

SEQ ID NO: 12170 - protein, 122 aa, Homo sapiens
EVQLVQSGAEVKKPGESLKISCKGSGYSFTSYWIGWVRQMPGKGLEWMGSIYPGDSHTRYRPSFQGQVTISADKSISTAYLQWSSLKASDTAMYYCARQAGDYYYYNGMDVWGQGTTVTVSS

SEQ ID NO: 12171 - protein, 122 aa, Homo sapiens
EVQLVQSGAEVKKPGESLKISCKGSGYSFTSYWIGWVRQMPGKGLEWMGIIYPGDSDTRYSPSFQGQVTISVDKSISTAYLQWSSLKASDTAMYYCARQKGDYYYHYGLDVWGQGTTVTVSS

SEQ ID NO: 12172 - protein, 122 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQKGDYYYFNGLDVWGQGTTVTVSS

SEQ ID NO: 12173 - protein, 122 aa, Homo sapiens
EVQLVQSGAEVKKPGESLKISCQGSGYRFISYWIGWVRQMPGKGLEWMGRIYPGDSDTRYSPSFQGQVTISVDKSISTAYLQWSSLKASDTAMYYCARQRGDYYYFNGLDVWGQGTTVTVSS

SEQ ID NO: 12174 - protein, 122 aa, Homo sapiens
EVQLVQSGAEVKKPGESLKISCKGSGYSFTSYWIGWVRQMPGKGLEWMGRIYPGDSDTRYSPSFQGQVTISADKSITTAYLQWSSLRASDTAMYYCARQRGDYYYFFGLDIWGQGTTVTVSL

SEQ ID NO: 12175 - protein, 122 aa, Homo sapiens
EVQLVQSGAEVKKPGESLKISCKGSGYRFSSYWIGWVRQMPGKGLEWMGSIFPGDSDTRYSPSFQGQVTISADKSITTAYLQWSSLKASDTAMYYCARQAGDYYYYNGMDVWGQGTTVTVSS

SEQ ID NO: 12176 - protein, 121 aa, Homo sapiens
QVQLVQSGAEVKKPGASVKVSCKASGYTFTNYGISWVRQAPGQGLEWMGWLSAYSGNTIYAQKLQGRVTMTTDTSTTTAYMELRSLRSDDTAVYYCARDRIVVRPDYFDYWGQGTLVTVSS

SEQ ID NO: 12177 - protein, 119 aa, Homo sapiens
EVQLLESGGGLVQPGGSLRLSCAASGFTFSSYAMNWVRQAPGKGLEWVSAISGRGGTTYYADSVKGRFTISRDNSKNTLYLQMSSLRAEDTAVYYCAKARANWDYFDYWGQGTLVTVSS

SEQ ID NO: 12178 - protein, 121 aa, Homo sapiens
QVQLVQSGAEVKKPGSSVKVSCKASGGTFRTYAINWVRQAPGQGLEWMGRINTVLGIVNHAQKFQGRVTITADKSTNTAYMELNSLRSEDTAVYYCAREKGVDYYYGIEVWGQGTTVTVSS

SEQ ID NO: 12179 - protein, 120 aa, Homo sapiens
QVQLQQWGAGLLKPSETLSLTCAVYGGSFSDYYWNWIRQPPGKGLEWIGEIHHSGSTNYNPSLKSRVTISVDTSKNQFSLKLSSVTAADTAVYYCARGYYDSGVYYFDYWAQGTLVTVSS

SEQ ID NO: 12180 - protein, 119 aa, Homo sapiens
QVQLVESGGGVVQPGRSLRLSCAASGFTFSTFAIHWVRQAPGKGLEWVAVISYDGGHKFYADSVKGRFTISRDNSKNTLYLQMNSLRAEDTAMYYCARGLGVWGAFDYWGQGTLVTVSS

SEQ ID NO: 12181 - protein, 123 aa, Homo sapiens
EVQLVQSGAEVKKPGESLTISCKGSGYSFSIYWIGWVRQMPGKGLEWMGIIFPGDSDIRYSPSFQGQVTISADKSISTAYLQWSSLKASDTAMYYCARQPGDWSPRHWYFDLWGRGTLVTVSS

SEQ ID NO: 12182 - protein, 126 aa, Homo sapiens
EVQLVQSGAEVKKPGESLKISCKGSGYNFTSYWIGWVRQMPGKGLEWMGIIYPGDSDTRYSPSFQGQVTISADKSISTAYLQWSSLKASDTAMYYCARWGTYYDILTGYFNWFDPWGQGTLVTVSS

SEQ ID NO: 12183 - protein, 121 aa, Homo sapiens
QVQLVESGGGVVQPGRSLRLSCAASGFTFSDYVIHWVRQAPGKGLEWVTVISYDGSNKYYADSVKGRFTISRDNSKNTLYLQMNSLSAEDTAMYYCARGGITGTTGVFDYWGQGTLVTVSS

SEQ ID NO: 12184 - protein, 125 aa, Homo sapiens
QVQLVQSGAEVKKPGASVKVSCKASGYTFTSYGISWVRQAPGQGLEWMGWISAYNGNSNYVQKFQGRVTMTTDTTTSTAYMELRSLTSDDTAVYYCAREYSYDSGTYFYYGMDVWGQGTTVTVSS

SEQ ID NO: 12185 - protein, 119 aa, Homo sapiens
EVQLLESGGDLVQPGGSLRLSCAASGFTFSSYAMSWVRQAPGKGLEWVSAISGRGGTTYYADSVKGRFTISRDNSKSTLCLQMNSLRAEDTAVYYCAKARANWDYFDYWGQGTLVTVSS

SEQ ID NO: 12186 - protein, 119 aa, Homo sapiens
EVQLLESGGGLVQPGGSLRLSCAASGFTFSSYAMNWVRQAPGKGLEWVSAISGRGGTTYYADSVKGRFTISRDNSKSTLCLQMNSLRAEDTAVYYCAKARANWDYFDYWGQGTLVTVSS

SEQ ID NO: 12187 - protein, 121 aa, Homo sapiens
QVQLVQSGAEVKKPGASVKVSCKAAGYTFTNYGISWVRQAPGQALEWMGWITTYSSNTIYAQKLQGRVTMTTDTSTSTAYMELRSLRSDDTAVYYCARDRVVVRPDYFDYWGQGTLVTVSS

SEQ ID NO: 12188 - protein, 121 aa, Homo sapiens
QVQLVQSGAEVKKPGASVKVSCKAAGYTFTNYGISWVRQAPGQGLEWMGWIITYNGNTIYAQRFQDRVTMTTDTSTSTAYMELRSLRSDDTAVYYCARDRIIVRPDYFDYWGQGTLVTVSS

SEQ ID NO: 12189 - protein, 120 aa, Homo sapiens
QVQLQQWGAGLLKPSETLSLTCAVYGGSFSGYYWNWIRQPPGKGLEWIGEINHSGSTNYNPSLKSRVTISVDTSKNQFSLKLSSVTAADTAVYYCARGNYGSGYYYFDLWGRGTQVTVSS

SEQ ID NO: 12190 - protein, 120 aa, Homo sapiens
QVQLQQWGAGLLKPSETLSLTCAVYGGSFSGYYWNWIRQPPGKGLEWIGEIHHSGSANYNPSLMSRVTISVDTSKNQFSLQLSSVTAADTAVYYCARGYYGSGYYYFDYWGQGTLVTVSS

SEQ ID NO: 12191 - protein, 120 aa, Homo sapiens
QVQLQQWGAGLLKPSETLSLTCAVYGGSFSDYYWNWIRQPPGKGLEWIGEIHHVGSTNYNPSLKSRVTISVDTSKSQFSLKLSSVTAADTAVYYCARGYYDSGVYYFDYWAQGTLVTVSS

SEQ ID NO: 12192 - protein, 120 aa, Homo sapiens
QVQLQQWGAGLLKPSETLSLTCAVYGGSFSDYYWNWIRQPPGKGLEWIGEIHHSGSTNYNPSLKSRVTISVDTSKNQFSLKLSSVTAADTAVYYCARGYYASGVYYFDYWGQGTLVTVSS

SEQ ID NO: 12193 - protein, 120 aa, Homo sapiens
QVQLQQWGAGLLKPSETLSLTCAVYGGSFSDYFWNWIRQPPGKGLEWIGEIHHSGSTNYNPSLKSRVTISVDTSKNQFSLNLSSVTAADTAVYYCARGLIGSGYYYFDYWDQGTLVTVSS

SEQ ID NO: 12194 - protein, 120 aa, Homo sapiens
QVQLQQWGAGLLKPSETLSLTCAVYGGSFSGYYWSWIRQPPGKGLEWIGEINHSGDTNYNPSLTSRVTISVDTSKNQFSLKLSSVTAADTAVYYCARLFYGSGIYYFDYWGQGTLVTVSS

SEQ ID NO: 12195 - protein, 120 aa, Homo sapiens
QVQLQQWGAGLLKPSETLSLTCAIYGGSFSGYYWSWIRQPPGKGLEWIGEINHSGDTNYNPSLTSRVTISVDTSKNQFSLKLSSVTAADTAVYYCARLFYGSGIYYFDYWGQGTLVTVSS

SEQ ID NO: 12196 - protein, 120 aa, Homo sapiens
QVQLQQWGAGLLKPSETLSLTCAVYGGSFSDYYWSWIRQPPGKGLEWIGEINHSGSTNYNPSLKSRVTISVDTSKNQFSLKLSSVTAADTAVYYCARLYYGSGTYYFDYWGQGTLVTVSS

SEQ ID NO: 12197 - protein, 120 aa, Homo sapiens
QVQLQQWGAGLLKPSETLSLTCAVYGGSFSGYYWSWIRQPPGKGLEWIGEIHHSGSTNYNPSLKSRVTISVDTSKNQFSLKLSSVTAADTAVYYCARLWYGSGSYYFDYWGQGTLVTVSS

SEQ ID NO: 12198 - protein, 120 aa, Homo sapiens
QVQLQQWGAGLLKPSETLSLTCAVSGGSFSGYYWTWIRQPPGKGLEWIGEIYHSGDTNYNPSLKSRVTISVDTSKNQFSLKLYSVTAADTAVYYCARLYFGSGIYYLDYWGQGTLVTVSS

SEQ ID NO: 12199 - protein, 124 aa, Homo sapiens
EVQLLESGGGLVQPGGSLRLSCAASGFTFSNYGMSWVRQAPGKGLEWVSAISGSAYSTYYADSVKGRFTISRDNSKNTLWLQMNSLRAEDTAVYYCAKAHYHGSGSYYTLFDYWGQGTLVTVSS

SEQ ID NO: 12200 - protein, 124 aa, Homo sapiens
EVQLLESGGGLVQPGGSLRLSCAASGFTFNNYGMNWVRQAPGKGLEWVSAISGTGYSTYYADSVKGRFTISRDNSKNTLYLQMNSLRAEDTAVYYCAKAHYFGSGSYYTLFDYWGQGTLVTVSS

SEQ ID NO: 12201 - protein, 124 aa, Homo sapiens
EVQLLESGGGLVQPGGSLRLSCAASGFTFTDYAMNWVRQAPGKGLEWVSTISGSGYATYYADSVKGRFTISRDNSKTTLYLQMNSLRAEDTAVYYCAKGHTLGSGSYYTLFDYWGQGTLVTVSS

SEQ ID NO: 12202 - protein, 124 aa, Homo sapiens
EVQLWESGGGSVQPGGSLRLSCAASGFTFSSYGMSWVRQAPGKGLEWVSGISGSGYSTYYADSVKGRFTISRDNSKNTLYLQMNSLRAEDTAVYYCAKGYYHGSGSYYTSFDYWGQGTLVTVSS

SEQ ID NO: 12203 - protein, 121 aa, Homo sapiens
QVQLVESGGGVVQTGRSLRLSCAASGFTFSSHAMHWVRQAPGKGLEWVAAISYDGSNKYYADSVKGRFTISRDNSKNTLYLQMNSLRAEDTAVYYCARGDYISSSGVFDYWGQGTLVTVSS

SEQ ID NO: 12204 - protein, 121 aa, Homo sapiens
QVQLVESGGGVVQPGRSLRLSCAASGFTFSSHAMHWVRQAPGKGLEWVAAISYDGSNKYYADSVKGRFTISRDNSKNTMYLQMNSLRAEDTAMCYCARGSITGSTGVFDYWGQGTLVTVSS

SEQ ID NO: 12205 - protein, 121 aa, Homo sapiens
QVQLVESGGGVVQPGRSLRLSCAASGFTFSSYAMHWVRQAPGKGLEWVAVISYDGSNEYYADSVKGRFTISRDNSKNTLYLQMNSLRAEDTAVYYCARGSIIGSTGVFDYWGQGTLVTVSS

SEQ ID NO: 12206 - protein, 121 aa, Homo sapiens
QVQVVESGGGVVQPGRSLRLSCAASGFTFSSYAMHWVRQAPGKGLEWVAVISYDGSYKYYADSVKGRFTISRDNSKNTLYLQMNSLRAEDTAVYYCARGSITGSTGVFDYWGQGTLVTVSS

SEQ ID NO: 12207 - protein, 121 aa, Homo sapiens
QVQLVESGGGVVQPGRSLRLSCAASGFTFSSYAIHWVRQAPGKGLEWVAVISYDGSNKYYADSVKGRFTISRDNSKNTLYLQMNSLRAEDTAVYYCARGSITGSTGVFDYWGQGTLVTVSS

SEQ ID NO: 12208 - protein, 108 aa, Artificial Sequence
  Description of Artificial Sequence: Synthetic polypeptide
  Synthetic (light-chain variable region of anti-EGFR antibody (modified))
DIQMTQSPSSLSASVGDRVTITCRASQGINNYLNWYQQKPGKAPKLLIYNTNNLQTGVPSRFSGSGSGTEFTLTISSLQPEDEATYYCLQHNSFPTFGQGTKLEIKRT

SEQ ID NO: 12209 - protein, 123 aa, Artificial Sequence
  Description of Artificial Sequence: Synthetic polypeptide
  Synthetic Amino acid sequence of heavy chain variable region of anti-HER2 antibody 41-B11
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHYYDSSGYSYFPDYWGQGTLVTVSS

SEQ ID NO: 12210 - protein, 125 aa, Artificial Sequence
  Description of Artificial Sequence: Synthetic polypeptide
  Synthetic Amino acid sequence of heavy chain variable region of anti-HER2 antibody 41-C6
QIQLVQSGAEVKKPGESLKISCRGSGYSFTSYWIGWVRQMPGKGLEWMGIIYPGDSDTRYSPSFQGQVTISADKSISTAYLQWSSLKASDTAMYYCARLSVAAAGTGGYNWFDPWGQGTLVTVSS

SEQ ID NO: 12211 - protein, 120 aa, Artificial Sequence
  Description of Artificial Sequence: Synthetic polypeptide
  Synthetic Amino acid sequence of heavy chain variable region of anti-HER2 antibody 41-E1
EVQLVESGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRDLYPAMAEYWGQGTLVTVSS

SEQ ID NO: 12212 - protein, 128 aa, Artificial Sequence
  Description of Artificial Sequence: Synthetic polypeptide
  Synthetic Amino acid sequence of heavy chain variable region of anti-HER2 antibody 44-C12
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARDSGYSYGYPMNYYYYYMDVWGKGTTVTVSS

SEQ ID NO: 12213 - protein, 123 aa, Artificial Sequence
  Description of Artificial Sequence: Synthetic polypeptide
  Synthetic Amino acid sequence of heavy chain variable region of anti-HER2 antibody 44-H4
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLVVGANPPTYYFDYWGQGTLVTVSS

SEQ ID NO: 12214 - protein, 119 aa, Artificial Sequence
  Description of Artificial Sequence: Synthetic polypeptide
  Amino acid sequence of 1E11 heavy chain variable region
EVKLVESGGGLVQPGGSLKLSCAASGFTFSSYTMSWVRQTPEKRLEWVAYISNGGGSTYYPDTVKGRFTISRDNAKNTLYLQMSSLKSEDTAMYYCARHLGGTASFDYWGQGTTVTVSS

SEQ ID NO: 12215 - protein, 119 aa, Artificial Sequence
  Description of Artificial Sequence: Synthetic polypeptide
  Amino acid sequence of hz1E11 heavy chain variable region
EVQLVESGGGLVQPGGSLRLSCAASGFTFSSYTMSWVRQAPGKGLEWVAYISNGGGSTYYPDTVKGRFTISRDNAKNSLYLQMNSLRAEDTAVYYCARHLGGTASFDYWGQGTLVTVSS

SEQ ID NO: 12216 - protein, 120 aa, Mus musculus
  Ab 4517 VH
EVQLVESGGDLVKPGGSLKLSCAASGFTFSSYGMSWVRLTPDKRLEWVATISGGGSYTYYPDSVKGRFTISRDIAKSTLYLQMSSLKSEDTAVYYCARKGNYGNYGKLAYWGQGTSVTVS

SEQ ID NO: 12217 - protein, 117 aa, Mus musculus
  Ab 4380/4381 VH
QVQLQQSGAELVKPGASVKVSCTASGYTFTNYWIHWVKQRPGQGLEWIGRIHPSDSDVHYNQRFRDKTTLTVDRSSSTAYMQLSSLTSEDSAVYYCAKSYYDSAMDYWGQGTSVTVS

SEQ ID NO: 12218 - protein, 117 aa, Mus musculus
  Ab 4382 VH
EVQLQQSGPELVKPGASVKISCTASGYTFTDYYMNWVKQSHGKSLEWIGDINPNNGGTNYNQKWKGKATLTIHKSSSTAYMELRSLTSEDSAVYFCVPGGLRSYFDYWGQGTTLTVS

SEQ ID NO: 12219 - protein, 117 aa, Mus musculus
  Ab 4383 VH
QIQLVQSGPERKKPGETVKISCKASGYTFTDYSIHWVKQAPGKGLKWMGWINTATGEPTHVDDFKGRFAFSLETSASTAYLQITNLKNEDTATYFCTAWAYEPYFDYWGQGTTLTVS

SEQ ID NO: 12220 - protein, 116 aa, Mus musculus
  Ab 4386 VH
QVQLQQPGAELVKPGASVKLSCKASGYTFTSYWMHWVKQRPGQGLEWIGMIHPNSGSINYNEKFKNKATLTVVISSSTAYMQLSSLTSEDSAVYYCAGYGNGPMDYWGQGTSVTVS

SEQ ID NO: 12221 - protein, 119 aa, Mus musculus
  Ab 4387 VH
QVQLQQSGAELVRPGTSVKMSCKASGYTFTNYWIGWAKQRPGHGLEWIGDILPGGGYTHYNEKFKGKATLTADKSSSTAFMQFSSLTSEDSAIYYCARGSSGYPYYFDYWGQGTTLTVS

SEQ ID NO: 12222 - protein, 116 aa, Mus musculus
  Ab 4519 VH
EIQLQQSGPELVKPGASVKVSCKASGYSFTDYNIYWVKQSHGKSLEWIGYIDPYNGGTSYNQKFKGKATLTVDKSSSTAFMHLNSLTSEDSAVYYCARGAGYALDYWGQGTSVTVS

SEQ ID NO: 12223 - protein, 120 aa, Artificial Sequence [sequence omitted]

SEQ ID NO: 12224 - protein, 121 aa, Artificial Sequence [sequence omitted]

SEQ ID NO: 12225 - protein, 127 aa, Artificial Sequence
  Description of Artificial Sequence: Synthetic polypeptide
  Synthetic construct
MVSTSQLLGLLLFWTSASRCDIVMTQSPATLSVTPGDRVSLSCRASQSINDYLYWYQQKLHESPRLLIKFASHSISGIPSRFSGSGSGSDFTLSINSVEPEDVGVYYCQNGHSFPLTFGAGTKLELK

SEQ ID NO: 12226 - protein, 136 aa, Artificial Sequence
  Description of Artificial Sequence: Synthetic polypeptide
  Synthetic construct
MGWSRIFLFLLSIIAGVHCQVQLQQSGPELVKPGASVRISCKASGYTFTNYFLHWMKQRPGQGLEWIGWIYPGNVNTKYSEKFKGKATLTADKSSSTAYMQLSSLTSEDSAVYFCARSTYYSMDYWGQGTSVTVSS

SEQ ID NO: 12227 - protein, 118 aa, Artificial Sequence
  Description of Artificial Sequence: Synthetic polypeptide
EVQLLESGGGLVQPGGSLRLSCAASGFTFSYYYMQWVRQAPGKGLEWVSYIGSSGGVTNYADSVKGRFTISRDNSKNTLYLQMNSLRAEDTAVYYCARVGLGDAFDIWGQGTMVTVSS

SEQ ID NO: 12228 - protein, 118 aa, Artificial Sequence
  Description of Artificial Sequence: Synthetic polypeptide
EVQLLESGGGLVQPGGSLRLSCAASGFTFSYYYMQWVRQAPGKGLEWVSIIGSSGGVTNYADSVKGRFTISRDNSKNTLYLQMNSLRAEDTAVYYCARVGLGDAFDIWGQGTMVTVSS

SEQ ID NO: 12229 - protein, 118 aa, Artificial Sequence
  Description of Artificial Sequence: Synthetic polypeptide
EVQLLESGGGLVQPGGSLRLSCAASGFTFSYYYMQWVRQAPGKGLEWVSVIGSSGGVTNYADSVKGRFTISRDNSKNTLYLQMNSLRAEDTAVYYCARVGLGDAFDIWGQGTMVTVSS

SEQ ID NO: 12230 - protein, 116 aa, Artificial Sequence
  Description of Artificial Sequence: Synthetic polypeptide
  Humanized antibody sequence
QSVEESGGRLVTPGTPLTLTCTVSGFSLSAYAMSWVRQAPEKGLEWIAVIYVIGATDYASWAKGRFTISRTSTTVDLRIPSPTTEDTATYFCARVYDSVWNHFNLWGPGTLVTVSS

SEQ ID NO: 12231 - protein, 119 aa, Artificial Sequence
  Description of Artificial Sequence: Synthetic polypeptide
  Humanized antibody sequence
EVQLVESGGGLVQPGGSLRLSCAASGFTVSAYAMSWVRQAPGKGLEWVAVIYVIGATDYASSAKGRFTISRDNSKNTLYLQMNSLRAEDTAVYYCARVYDSVWNHFNLWGQGTLVTVSS

SEQ ID NO: 12232 - protein, 117 aa, Artificial Sequence
  Description of Artificial Sequence: Synthetic polypeptide
  Humanized antibody sequence
QSVEESGGRLVTPGTPLTLTCTVSGLTISSYYMSWVRQAPGKGLEWIGTINPGANTYFASWAKGRFTISRTSTTVDLKITSPTTEDTATYFCAREGDSNDWGVFDLWGQGTLVTVSS

SEQ ID NO: 12233 - protein, 117 aa, Artificial Sequence
  Description of Artificial Sequence: Synthetic polypeptide
  Humanized antibody sequence
QSLEESGGRLVQPGTPLTLSCTASGLTISSYYMSWVRQAPGKGLEWVGTINPGANTYFASSAKGRFTISRSSTTLDLKMTSPTAEDTATYYCAREGDSNDWGVFDLWGQGTLVTVSS

SEQ ID NO: 12234 - protein, 113 aa, Artificial Sequence
  Description of Artificial Sequence: Synthetic polypeptide
  Humanized antibody sequence
QSLEESGGRLVTPGTPLTLTCTVSGFSLNNYAVGWVRQAPGKGLEWIGIIYLSGNTDYANWAKGRFTISKTSTTVDLKITSPTTEDTATYFCARKFDTGYDIWGPGTLVTVSS

SEQ ID NO: 12235 - protein, 116 aa, Artificial Sequence
  Description of Artificial Sequence: Synthetic polypeptide
  Humanized antibody sequence
QSVEESGGRLVMPGTPLTLTCTVSGFSLSSNAISWVRQAPEKGLEWIGVIYVIGVTDYASWAQGRFTISKTSTTVDLKIPSPTTEDTATYFCARVYDSGWNHFNLWGPGTLVTVSS

SEQ ID NO: 12236 - protein, 120 aa, Artificial Sequence
  Description of Artificial Sequence: Synthetic polypeptide
  Humanized antibody sequence
QSVEESGGRLVTPGTPLTLTCTVSGIDLNSNGMSWVRQAPGEGLEWIGASSIDGTTYYTNWAKGRFTISKTSSTTVDLKITSPTTEDTATYFCTRGEYAGVVGSNYFDLWGQGTLVTVSS

SEQ ID NO: 12237 - protein, 122 aa, Artificial Sequence
  Description of Artificial Sequence: Synthetic polypeptide
  Humanized antibody sequence
EVQLVESGGGLVQPGGSLRLSCAASGFTVSSNGMSWVRQAPGKGLEWVGASSIDGTTYYTNSAKGRFTISRDNSKNTLYLQMNSLRAEDTAVYYCARGEYAGVVGSNYFDLWGQGTLVTVSS

SEQ ID NO: 12238 - protein, 128 aa, Artificial Sequence
  Description of Artificial Sequence: Synthetic polypeptide
  Humanized antibody sequence
QSMEESGGRLVTPGTPLTLTCTVSGFSLSDYALSWVRQAPGKGLEWIGMISSGDNTYYASWAKGRFTISKASTTVDLKITSPTTEDTATYFCARDKDASSGGYLVLDLLDVPDGMDLWGPGTLVTVSS

SEQ ID NO: 12239 - protein, 116 aa, Artificial Sequence
  Description of Artificial Sequence: Synthetic polypeptide
  Humanized antibody sequence
QSLEESGGRLVTPGGSLTLTCTVSGIDLSSNAISWVRQAPEKGLEWIAVIYVVGATDYASWAKGRFTISRTSTTVDLKMTSLTTEDTATYFCARVYDSGWNHFNLWGPGTLVTVSS

SEQ ID NO: 12240 - protein, 119 aa, Artificial Sequence
  Description of Artificial Sequence: Synthetic polypeptide
  Humanized antibody sequence
EVQLVESGGGLVQPGGSLRLSCAASGFTVSSNAISWVRQAPGKGLEWVAVIYVVGATDYASSAKGRFTISRDNSKNTLYLQMNSLRAEDTAVYYCARVYDSGWNHFNLWGQGTLVTVSS

SEQ ID NO: 12241 - protein, 116 aa, Artificial Sequence
  Description of Artificial Sequence: Synthetic polypeptide
  Humanized antibody sequence
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGQGTLVTVSS

SEQ ID NO: 12242 - protein, 116 aa, Artificial Sequence
  Description of Artificial Sequence: Synthetic polypeptide
  Humanized antibody sequence
QSVEESGGRLVTPGTPLTLTCTVSGFSLSNYAMTWVRQAPGKGLEWIGVISFGGNTYYANWAKGRFTISKTSTTVDLKITSPTTEDTATYFCARWDAENNEILNLWGPGTLVTVSS

SEQ ID NO: 12243 - protein, 119 aa, Artificial Sequence
  Description of Artificial Sequence: Synthetic polypeptide
  Humanized antibody sequence
QSVEESGGRLVTPGTPLTLTCTVSGIDLSNYAMGWVRQAPGKGLEYIGMIGVNGRAWYATWAKGRFTISKTSPTVDLKITSPTTEDTATYFCARLIDERSTYSYVFDLWGQGTLVTVSS

SEQ ID NO: 12244 - protein, 119 aa, Artificial Sequence
  Description of Artificial Sequence: Synthetic polypeptide
  Humanized antibody sequence
QSVEESGGRLVPPGTPLTLTCTVSGIDLSSYAMGWVRQAPGKGLEYIGMIDVSGSTYYADWAKGRLTISKTPTTVDLEITSPTTEDTATYFCARLIDERSTYSYAFDLWGQGTLVTVSS

SEQ ID NO: 12245 - protein, 120 aa, Artificial Sequence
  Description of Artificial Sequence: Synthetic polypeptide
  Humanized antibody sequence
QSLEESGGRLVTPGTPLTLTCTASGFSLSSYDMSWVRQAPGKGLEWIGIIYAGSASTWFASWVKGRFTISKTSTTVDLKMTSLTTEDTATYFCARVGYSGYGYDDNLDMWGQGTLVTVSS

SEQ ID NO: 12246 - protein, 118 aa, Artificial Sequence
  Description of Artificial Sequence: Synthetic polypeptide
  Humanized antibody sequence
QSVEESGGRLVTPGTPLTLTCTASGFSLSNYWMGWVRQAPGEGLEWIGTISYDGNTYYASWAKGRFTISRTSTTVDLKMTSLTTEDTAIYFCATVNYPDYSTGAFNIWGPGTLVTVSS

SEQ ID NO: 12247 - protein, 121 aa, Artificial Sequence
  Description of Artificial Sequence: Synthetic polypeptide
  Humanized antibody sequence
EVQLVESGGGLVQPGGSLRLSCAASGFTVSNYWMGWVRQAPGKGLEWIGTISYDGNTYYASSAKGRFTISRDNSKNTLYLQMNSLRAEDTAVYYCATVNYPDYSTGAFNIWGQGTLVTVSS

SEQ ID NO: 12248 - protein, 117 aa, Artificial Sequence
  Description of Artificial Sequence: Synthetic polypeptide
  Humanized antibody sequence
QSVEESGGRLVTPGTPLTLTCTVSGFSLSTYYMSWVRQAPGKGLEWIGIIYVSGITDYARWAKGRFTISKTSTTVDLKMTSLTTEDTATYFCARHIDSSGWDGLGIWGQGTLVTVSS

SEQ ID NO: 12249 - protein, 116 aa, Artificial Sequence
  Description of Artificial Sequence: Synthetic polypeptide
  Humanized antibody sequence
QSLEESGGRLVTPGTPLTLTCTASGFTIGRYYMSWVRQAPGKGLEWIGIIYTHGVNPDYASWAKGRFTISRPSTTVDLKITSPTTEDTATYFCARVGGFNDYSDIWGPGTLVTVSS

SEQ ID NO: 12250 - protein, 119 aa, Artificial Sequence
  Description of Artificial Sequence: Synthetic polypeptide
  Humanized antibody sequence
EVQLVESGGGLVQPGGSLRLSCAASGFTVGRYYMSWVRQAPGKGLEWIGIIYTHGVNPDYASSAKGRFTISRDNSKNTLYLQMNSLRAEDTAVYYCARVGGFNDYSDIWGQGTLVTVSS

SEQ ID NO: 12251 - protein, 118 aa, Artificial Sequence
  Description of Artificial Sequence: Synthetic polypeptide
  Humanized antibody sequence
QSLEESGGRLVTPGTPLTLTCTASGFSLSSYAMGWFRQAPGKGLEWIAYIFASGSTYYASWAKGRFTISKTSTTVELKITSLTTEDTATYFCARGSGARFFPNYFAIWGPGTLVTVSS

SEQ ID NO: 12252 - protein, 119 aa, Artificial Sequence
  Description of Artificial Sequence: Synthetic polypeptide
  Humanized antibody sequence
QSVEESGGRLVTPGTPLTLTCTVSGFSLSTYTMNWVRQAPGKGLEYIGFISSSSSIDYVSWAKGRFTISKTSTTVDLKITSPTTEDTATYFCARDFYADYIGGGYPYIWGPGTLVTVSS

SEQ ID NO: 12253 - protein, 123 aa, Artificial Sequence
  Description of Artificial Sequence: Synthetic polypeptide
  Humanized antibody sequence
QSLEESGGDLVKPGGTLTLTCTASGFSFSDDHYMCWVRQAPGKGLQWIACMYVGSSGATYYASWAKGRFTISKTSSTTVTLQMTSLTAADTATYFCARDDWTSYYAWGYWALWGPGTLVTVSS

SEQ ID NO: 12254 - protein, 119 aa, Artificial Sequence
  Description of Artificial Sequence: Synthetic polypeptide
  Humanized antibody sequence
EVQLVESGGGLVQPGGSLRLSCAASGFTVSSNAISWVRQAPGKGLEWVGVIYVIGVTDYASSAQGRFTISRDNSKNTLYLQMNSLRAEDTAVYYCARVYDSGWNHFNLWGQGTLVTVSS

SEQ ID NO: 12255 - protein, 115 aa, Artificial Sequence
  Description of Artificial Sequence: Synthetic polypeptide
EVQLQQSGTVLARPGASVKMSCKASGYIFTSYWVHWVKQRPGQGLEWIGGFYPGNSDSRYNQKFKGKATLTAVTSASTAYMDLSSLTNEDSAVYFCTRRDSPQYWGQGTTLTVSS

SEQ ID NO: 12256 - protein, 118 aa, Artificial Sequence
  Description of Artificial Sequence: Synthetic polypeptide
QVQLQQSGAELMKPGASVKISCKATGYTFSSSWIEWLKQRPGHGLEWIGEFLPGSGSTDYNEKFKGKATFTADTSSDTAYMLLSSLTSEDSAVYYCATDGNYDWFAYWGQGTLVTVSA

SEQ ID NO: 12257 - protein, 115 aa, Artificial Sequence
  Description of Artificial Sequence: Synthetic polypeptide
QVQLVQSGAEVKKPGASVKVSCKASGYIFTSYWVHWVRQAPGQRLEWMGGFYPGNSDSRYSQKFQGRVTITRDTSASTAYMELSSLRSEDTAVYYCTRRDSPQYWGQGTLVTVSS

SEQ ID NO: 12258 - protein, 118 aa, Artificial Sequence
  Description of Artificial Sequence: Synthetic polypeptide
QVQLVQSGAEVKKPGASVKVSCKASGYTFSSSWMHWVRQAPGQGLEWMGIFLPGSGSTDYAQKFQGRVTMTRDTSTSTVYMELSSLRSEDTAVYYCATDGNYDWFAYWGQGTLVTVSS

SEQ ID NO: 12259 - protein, 117 aa, Artificial Sequence
  Description of Artificial Sequence: Synthetic polypeptide
EVQLVESGGGLVKPGGSLKLSCAASGFTFTTYAMSWVRQTPEKRLEWVATISSGGTYTYYPDSVKGRFTISRDNAKNALYLQMSSLRSEDTAMYYCATQGNYSLDFWGQGTSLTVSS

SEQ ID NO: 12260 - protein, 114 aa, Artificial Sequence
  Description of Artificial Sequence: Synthetic polypeptide
EVQLVESGGGLVQPGGSLKLSCAASGFIFSSYGMSWVRQSPDRRLELVASINTFGDRTYYPDSVKGRFTISRDNAKNTLYLQMTSLKSEDTAIYYCARGTGTYWGQGTTLTVSS

SEQ ID NO: 12261 - protein, 117 aa, Artificial Sequence
  Description of Artificial Sequence: Synthetic polypeptide
QVQLQQSGAELVKPGASVKLSCKASGYTFTSYYMYWVKQRPGQGLEWIGEINPSNGGTNFNEKFKSKATLTVDKSSSTAYMQLSSLTSEDSAVYYCTRGGYYPFDYWGQGTTLTVSS

SEQ ID NO: 12262 - protein, 121 aa, Artificial Sequence
  Description of Artificial Sequence: Synthetic polypeptide
DVQLQESGPGLVKPSQSLSLTCTVTGYSITSDYAWNWIRQFPGNKLEWMGYISFSGYTSYNPSLKSRISVTRDTSRNQFFLQLTSVTTEDTATYYCAREVNYGDSYHFDYWGQGTIVTVSS

SEQ ID NO: 12263 - protein, 117 aa, Artificial Sequence
  Description of Artificial Sequence: Synthetic polypeptide
EVQLVESGGGLVKPGGSLRLSCAASGFTFTTYAMSWVRQAPGKGLEWVSSISSGGTYTYYADSVKGRFTISRDNAKNSLYLQMNSLRAEDTAVYYCATQGNYSLDFWGQGTTVTVSS

SEQ ID NO: 12264 - protein, 117 aa, Artificial Sequence
  Description of Artificial Sequence: Synthetic polypeptide
EVQLVESGGGLVKPGGSLRLSCAASGFTFTTYAMNWVRQAPGKGLEWVSSISSGGTYTYYADSVKGRFTISRDNAKNSLYLQMNSLRAEDTAVYYCATQGNYSLDFWGQGTTVTVSS

SEQ ID NO: 12265 - protein, 117 aa, Artificial Sequence
  Description of Artificial Sequence: Synthetic polypeptide
EVQLVESGGGLVKPGGSLRLSCAASGFTFTTYAMSWVRQAPGKGLEWVSTISSGGTYTYYADSVKGRFTISRDNAKNSLYLQMNSLRAEDTAVYYCATQGNYSLDFWGQGTTVTVSS

SEQ ID NO: 12266 - protein, 112 aa, Artificial Sequence
  Description of Artificial Sequence: Synthetic polypeptide
DVVMTQSPLSLPVTLGQPASISCRSSQSLLDSDGKTYLNWFQQRPGQSPRRLIYLVSNRDSGVPDRFSGSGSGTDFTLKISRVEAEDVGVYYCWQGTHFPQTFGGGTKVEIK

SEQ ID NO: 12267 - protein, 112 aa, Artificial Sequence
  Description of Artificial Sequence: Synthetic polypeptide
DVVMTQSPLSLPVTLGQPASISCRSSQSLLDSDGKTYLNWFQQRPGQSPRRLIYLVSKRDSGVPDRFSGSGSGTDFTLKISRVEAEDVGVYYCWQGTHFPQTFGGGTKVEIK

SEQ ID NO: 12268 - protein, 112 aa, Artificial Sequence
  Description of Artificial Sequence: Synthetic polypeptide
DVVMTQSPLSLPVTLGQPASISCRSSQSLLDSDGKTYLYWFQQRPGQSPRRLIYLVSNRDSGVPDRFSGSGSGTDFTLKISRVEAEDVGVYYCWQGTHSPYTFGQGTKLEIK

SEQ ID NO: 12269 - protein, 112 aa, Artificial Sequence
  Description of Artificial Sequence: Synthetic polypeptide
DVVMTQSPLSLPVTLGQPASISCRSSQSLLDSDGKTYLNWFQQRPGQSPRRLIYLVSNRDSGVPDRFSGSGSGTDFTLKISRVEAEDVGVYYCWQGTHSPYTFGQGTKLEIK

SEQ ID NO: 12270 - protein, 112 aa, Artificial Sequence
  Description of Artificial Sequence: Synthetic polypeptide
DVVMTQSPLSLPVTLGQPASISCRSSQSLLDSDGKTYLYWFQQRPGQSPRRLIYLVSERDSGVPDRFSGSGSGTDFTLKISRVEAEDVGVYYCWQGTHSPYTFGQGTKLEIK

SEQ ID NO: 12271 - protein, 115 aa, Artificial Sequence
  Description of Artificial Sequence: Synthetic polypeptide
QLVLTQSPSASASLGASVKLTCTLSSQHRTYTIEWHQQQPEKGPRYLMKVKKDGSHSKGDGIPDRFSGSSSGAERYLTISSLQSEDEADYYCGVGDAIKGQSVFVFGGGTKVEIK

SEQ ID NO: 12272 - protein, 115 aa, Artificial Sequence
  Description of Artificial Sequence: Synthetic polypeptide
QLVLTQSPSASASLGASVKLTCTLSSQHRTYTIAWHQQQPEKGPRYLMKVKKDGSHSKGDGIPDRFSGSSSGAERYLTISSLQSEDEADYYCGVGDAIKGQSVFVFGGGTKVEIK

SEQ ID NO: 12273 - protein, 115 aa, Artificial Sequence
  Description of Artificial Sequence: Synthetic polypeptide
QLVLTQSPSASASLGASVKLTCTLSSQHRTYTIEWHQQQPEKGPRYLMEVKKDGSHSKGDGIPDRFSGSSSGAERYLTISSLQSEDEADYYCGVGDAIKGQSVFVFGGGTKVEIK

SEQ ID NO: 12274 - protein, 123 aa, Mus musculus
QVQLQQSGAELVKPGASVKLSCKASGYTFTSYWMHWVKQRPGQGLEWIGEINPSNGRTNYNEKFKRKATLTVDKSSSTAYMQLSSLTSEDSAVYYFARGRPDYYGSSKWYFDVWGAGTTVTVS

SEQ ID NO: 12275 - protein, 137 aa, Rattus norvegicus
MDIRLSLVFLVLFIKGVQCEVHLVESGGGLVQPGRSLKLSCAASGFTFSNYYMTWVRQAPTKGLEWVAYISSGGGSTYYRDSVKGRFTISRDNAKSTLYLQMDSLRSEDTATYYCTTEDYGYWFAYWGQGTLVTVSS

SEQ ID NO: 12276 - protein, 118 aa, Artificial Sequence
  Description of Artificial Sequence: Synthetic polypeptide
QVQLVESGGGVVQPGRSLRLSCAASGFTFSNYYMTWVRQAPGKGLEWVAYISSGGGSTYYRDSVKGRFTISRDNSKNTLYLQMNSLRAEDTAVYYCAREDYGYWFAYWGQGTLVTVSS

SEQ ID NO: 12277 - protein, 118 aa, Artificial Sequence
  Description of Artificial Sequence: Synthetic polypeptide
EVQLVESGGGVVQPGRSLRLSCAASGFTFSNYYMTWVRQAPTKGLEWVAYISSGGGSTYYRDSVKGRFTISRDNSKNTLYLQMNSLRAEDTAVYYCTTEDYGYWFAYWGQGTLVTVSS

SEQ ID NO: 12278 - protein, 122 aa, Homo sapiens
QVELVESGGGLVQPGGSLRLSCAASGFTFSNYWMHWVRQAPGKGLEWVSGISGWSSWTYYADSVKGRFTISRDNSKNTLYLQMNSLRAEDTAVYYCARFGIDAYTKVYFDYWGQGTLVTVSS

SEQ ID NO: 12279 - protein, 115 aa, Homo sapiens
QVELVESGGGLVQPGGSLRLSCAASGFTWSSFAMSWVRQAPGKGLEWVSYISYLGSYTGYADSVKGRFTISRDNSKNTLYLQMNSLRAEDTAVYYCARGTKFDYWGQGTLVTVSS

SEQ ID NO: 12280 - protein, 123 aa, Artificial Sequence
  Description of Artificial Sequence: Synthetic polypeptide
QVQLVQSGAEVVKPGASVKLSCKASGYTFTSYWMHWVKQRPGQGLEWIGEINPSNGRTNYNQKFQGKATLTVDKSSSTAYMQLSSLTSEDSAVYYFARGRPDYYGSSKWYFDVWGQGTTVTVS

SEQ ID NO: 12281 - protein, 122 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARGHDFGGNSGYFDYWGQGTLVTVSS

SEQ ID NO: 12282 - protein, 117 aa, Homo sapiens
QVQLVESGAEVKKPGASVKVSCKASGYTFTTYNMHWVRQAPGQGPEWMGVINPSGSSTSYAQKFQGRVTMTRDTSTSTVYMQLSSLRSEDTAVYYCARWSHEAFDIWGQGTMVTVSS

SEQ ID NO: 12283 - protein, 126 aa, Homo sapiens
EVQLVESGGGLVKPGGSLRLSCAASGFSISDYYMSWIRQAPGKGLEWVSYISSSSRYTNYADSVKGRFTISRDSAKNSLYLQMNSLRAEDTAVYYCAREGGGCNNTSCYGDGMDVWGQGTTVTVSS

SEQ ID NO: 12284 - protein, 120 aa, Homo sapiens
EVQLVESGGGLVQPGGSLRLSCAASGFTFSIYAMTWVRQAPGKGLEWVSSISGSSGYIYYADSLKGRFTISRDNAKNSLYLQMNSLRDEDTAVYYCARGWQGAYYGMDVWGQGTTVTVSS

SEQ ID NO: 12285 - protein, 113 aa, Homo sapiens
QLVQSGSEVKKPGASVKVSCKASGYTFTSYYMHWVRQAPGQGLEWMGIINPSGGSTSYAQKFQGRVTMTRDTSTSTVYMELSSLRSEDTAVYYCAVGGGGRYWGQGTTVTVSS

SEQ ID NO: 12286 - protein, 119 aa, Homo sapiens
QLVQSVAEVKKPGASLTVSCTASGYTFDDYLITWVRQAPGQGLEWLGWINTFNGKTNYAQKFQARVTMTRDTSTETAYLELASLTSDDTAVYYCARDYSGWYPFYLDFWGQGTLVTVSS

SEQ ID NO: 12287 - protein, 122 aa, Homo sapiens
QVQLVESGGGVVQPGRSLRLSCAASGFTFSRHDMYWVRQAPGKGLEWVAGIWYTGSKIFYADSVKGRFSISRDNSKNTLYLQMNSLRAEDTAVYYCAREFEAWSGYFGFDKWGQGTLVTVSS

SEQ ID NO: 12288 - protein, 126 aa, Homo sapiens
QVQLVQSGAEVKKPGASVKVSCKASSYTFTSNGISWVRQAPGQGLEWMGWINTYNGLTKYAQKLQGRLTMTTDTSTSTAYMELRSLRSDDTAVYYCARDRQRWLQGGGSGYGMDVWGQGTTVTVSS

SEQ ID NO: 12289 - protein, 122 aa, Homo sapiens
EVQLLESGGGLVQPGGSLRLSCAASGFTFSSYEMNWVRQAPGKGLEWVSYISTGDSTRSYADSVRGRFTISRDNAKNSLYLQMNSLRAEDTAVYYCARESGTWYGGWYFDLWGRGTLVTVSS

SEQ ID NO: 12290 - protein, 122 aa, Homo sapiens
QVQLVQSGAEVKKPGASVKVSCKGSGYNFPTQAIHWVRQAPGQRLEWMGWTNTANGNAKYSQKFQGRVTITRDTYASTDYMELSSLTSEDTAIYYCTRDRFTGSGTYGMDVWGQGTTVTVSS

SEQ ID NO: 12291 - protein, 121 aa, Homo sapiens
QVQLVQSGAEVMKPGASVKVSCKASGYTFTSYGISWVRQAPGQGLEWMGWISAYNGNTNYAQMLQGRVTMTTDTSTSTAYMELRSLRSDDTAVYYCARRGLSSYYYGMDVWGQGTTVTVSS

SEQ ID NO: 12292 - protein, 118 aa, Homo sapiens
QVQLVQSGAEVKKPGSSVKVSCKASGGSFNSFSISWVRQAPGQGLEWMGGITPMFGIGDNAQKFQDRVAITADESMSTFYMELSNLRFEDTAMYFCAREVGGLGFDVWGQGTTVTVSS

SEQ ID NO: 12293 - protein, 124 aa, Homo sapiens
EVQLVESGGGVVQPGRSLRLSCAASRFTFSNYAMHWVRQAPGKGLEWVAVISYDGSNKYYADSVKGRFTISRDNSKNTLYLQMNSLRAEDTAVYYCAREVLEYYYDSSGAFDIWGQGTMVTVSS

SEQ ID NO: 12294 - protein, 115 aa, Homo sapiens
QVQLVQSGAEVKKPGTSVKVSCKASGGAFNRFPISWVRQAPGQGLEWMGWISPNGGNTNYAQKFQGRVTMTRDTSINTAYMEVSSLTSDDTAVYYCTQGRVAFVWGQGTLVTVSS

SEQ ID NO: 12295 - protein, 119 aa, Homo sapiens
QVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARELWYGEGFDPWGQGTLVTVSS

SEQ ID NO: 12296 - protein, 121 aa, Artificial Sequence
  Description of Artificial Sequence: Synthetic polypeptide
QVQLQESGGGVVQPGRSLRLSCSASGFTFSDYYMYWVRQAPGKGLEWVAYITNYGGSTYYPDTVKGRFTISRDNAKNTLFLQMDSLRPEDTGVYFCARQSNYDYDGWFAYWGQGTPVTVSS

SEQ ID NO: 12297 - protein, 125 aa, Artificial Sequence
  Description of Artificial Sequence: Synthetic polypeptide
  immunoglobulin heavy chain variable region
EVQLLESGGGLVQPGGSLRLSCAASGFTFSSYAMSWVRQAPGKGLEWVSAISGSGGITYYADSVKGRFTISRDNSKNTLYLQMNSLRAEDTAVYYCAKDLGYGDFYYYYYGMDVWGQGTTVTVSS

SEQ ID NO: 12298 - protein, 124 aa, Homo sapiens
QLQLQESGPGLVKPSETLSLTCTVSGGSIRSSSYYWGWIRQPPGKGLEWIGGIYYSGSTYYNPSLKSRVTMSVDTSKNQFSLKLSSVTAADTAVYYCARQRGHSSGWWYFDLWGRGTLVTVSSA

SEQ ID NO: 12299 - protein, 121 aa, Homo sapiens; identical to SEQ ID NO: 5363

SEQ ID NO: 12300 - protein, 120 aa, Homo sapiens
QVQLQESGPGLVKPSETLSLTCTVSGGSISSYYWSWIRQPPGRGLEWIGYFFYSGYTNYNPSLKSRVTMSVDTSKNQFSLKLSSVTAADTAVYYCACITGTTKGGMDVWGQGATVTVSSA

SEQ ID NO: 12301 - protein, 120 aa, Homo sapiens
QVQLQESGPGLVKPSETLSLTCTVSGGSISSYYWSWIRQPPGKGLEWIGYFFYSGYTNYNPSLKSRVTISVDTSKNQFSLKLSSVTAADTAVYYCACITGTTKGGMDVWGQGTTVTVSSA

SEQ ID NO: 12302 - protein, 124 aa, Homo sapiens
QLQLQESGPGLVKPSETLSLTCTVSGGSINSSSNYWGWIRQPPGKGLAWIGGIYYSGSTYYNPSLRSRVTMSVDTSKNQFSLKLSSVTAADTAVYYCARQRGHSSGWWYFDLWGRGTLVTVSSA

SEQ ID NO: 12303 - protein, 198 aa, Homo sapiens
TMKHLWFFLLLVAAPRWVLSQLQLQESGPGLVKPSETLSLTCTVSGGSIRSSSYYWGWIRQPPGKGLEWIGGIYYSGSTYYNPSLKSRVTMSVDTSKNQFSLKLSSVTAADTAVYYCARQRGHSSGWWYFDLWGRGTLVTVSSASTKGPSVFPLAPCSRSTSESTAALGCLVKDYFPEPVTVSWNSGALTSGVHTFPA

SEQ ID NO: 12304 - protein, 145 aa, Homo sapiens
TMDWTWRILFLVAAATSAHSQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSASTKG

SEQ ID NO: 12305 - protein, 204 aa, Homo sapiens
TMKHLWFFLLLVAAPRWVLSQVQLQESGPGLVKPSETLSLTCTVSGGSISSYYWSWIRQPPGRGLEWIGYFFYSGYTNYNPSLKSRVTMSVDTSKNQFSLKLSSVTAADTAVYYCACITGTTKGGMDVWGQGATVTVSSASTKGPSVFPLAPCSRSTSESTAALGCLVKDYFPEPVTVSWNSGALTSGVHTFPAVLQSSGLYSL

SEQ ID NO: 12306 - protein, 181 aa, Homo sapiens
MKHLWFFLLLVAAPRWVLSQVQLQESGPGLVKPSETLSLTCTVSGGSISSYYWSWIRQPPGKGLEWIGYFFYSGYTNYNPSLKSRVTISVDTSKNQFSLKLSSVTAADTAVYYCACITGTTKGGMDVWGQGTTVTVSSASTKGPSVFPLAPCSRSTSESTAALGCLVKDYFPEPVTVSWNS

SEQ ID NO: 12307 - protein, 186 aa, Homo sapiens
TMKHLWFFLLLVAAPRWVLSQLQLQESGPGLVKPSETLSLTCTVSGGSINSSSNYWGWIRQPPGKGLAWIGGIYYSGSTYYNPSLRSRVTMSVDTSKNQFSLKLSSVTAADTAVYYCARQRGHSSGWWYFDLWGRGTLVTVSSASTKGPSVFPLAPCSRSTSESTAALGCLVKDYFPEPVTVSWNS

SEQ ID NO: 12308 - protein, 127 aa, Mus musculus
LLTAIPGILSDVQLQESGPGLVKPSQSLSLTCSVTGYSITGGYLWNWIRQFPGNKLEWMGYISYDGTNNYKPSLKDRISITRDTSKNQFFLKLNSVTNEDTATYYCARYGRVFFDYWGQGTTLTVSS

SEQ ID NO: 12309 - protein, 130 aa, Mus musculus
EVQLVESGGGLVPPGGSLKLSCAASGFIFSSYGMSWVRQTPGKSLELVATINNNGDSTYYPDSVKGRFTISRDNAKNTLYLQMSSLKSEDTAMFYCARALISSATWFGYWGQGTLVTVSAAKTTAPSVYP

SEQ ID NO: 12310 - protein, 135 aa, Mus musculus
EIQLQQSGPELMKPGASVKISCKASGYSFSSHYMHWVKQSHGKSLEWIGYIDPSNGETTYNQKFKGKATLTVDTSSSTANVHLSSLTSDDSAVYFCARGDYRYNGDWFFDVWGAGTTVTVSSAKTDSPIGLSGPI

SEQ ID NO: 12311 - protein, 117 aa, Artificial Sequence
  Description of Artificial Sequence: Synthetic polypeptide
  recombinant immunoglobulin
EVQLVESGGGLVQPGGSLRLSCAASGYSFSSHYMHWVRQAPGKGLEWVGYIDPSNGETTYNQKFKGRFTISRDNSKNTLYLQMNSLRAEDTAVYYCAARGDYRYNGDWFFDVWGQGT

SEQ ID NO: 12312 - protein, 119 aa, Homo sapiens
EVQLLESGGGLVQPGGSLRLSCAASGFTFSSYGMVWVRQAPGKGLEWVSSISSSGGLTWYADSVKGRFTISRDNSKNTLYLQMNSLRAEDTAVYYCASPPGIAVARDYWGQGTLVTVSS

SEQ ID NO: 12313 - protein, 125 aa, Homo sapiens
EVQLLESGGGLVQPGGSLRLSCAASGFTFSRYNMWWVRQAPGKGLEWVSVIRSSGGYTGYADSVKGRFTISRDNSKNTLYLQMNSLRAEDTAVYYCARWNSGYSYWDYYYGMDVWGQGTTVTVSS

SEQ ID NO: 12314 - protein, 116 aa, Homo sapiens
EVQLLESGGGLVQPGGSLRLSCAASGFTFSPYMMVWVRQAPGKGLEWVSWISPSGGYTFYADSVKGRFTISRDNSKNTLYLQMNSLRAEDTAVYYCAYGTYPLTYWGQGTLVTVSS

SEQ ID NO: 12315 - protein, 130 aa, Homo sapiens
EVQLLESGGGLVQPGGSLRLSCAASGFTFSNYYMMWVRQAPGKGLEWVSVIGSSGGMTNYADSVKGRFTISRDNSKNTLYLQMNSLRAEDTAVYYCARGYPTGYYDSSGWVYSYYGIDVWGQGTTVTVSS

SEQ ID NO: 12316 - protein, 123 aa, Homo sapiens
EVQLLESGGGLVQPGGSLRLSCAASGFTFSMYSMQWVRQAPGKGLEWVSVIGSSGGQTGYADSVKGRFTISRDNSKNTLYLQMNSLRAEDTAVYYCARVRDYYGSGSYYLDPWGQGTLVTVSS

SEQ ID NO: 12317 - protein, 117 aa, Homo sapiens
EVQLLESGGGLVQPGGSLRLSCAASGFTFSWYSMSWVRQAPGKGLEWVSSISSSGGPTHYADSVKGRFTISRDNSKNTLYLQMNSLRAEDTAVYYCARDSSYSGTSWGQGTLVTVSS

SEQ ID NO: 12318 - protein, 120 aa, Homo sapiens
EVQLLESGGGLVQPGGSLRLSCAASGFTFSYYPMMWVRQAPGKGLEWVSSIWPSGGFTKYADSVKGRFTISRDNSKNTLYLQMNSLRAEDTATYYCARVSSSSWYGYLYWGQGTLVTVSS

SEQ ID NO: 12319 - protein, 119 aa, Homo sapiens
EVQLLESGGGLVQPGGSLRLSCAASGFTFSWYSMWWVRQAPGKGLEWVSSIVSSGGQTRYADSVKGRFTISRDNSKNTLYLQMNSLRAEDTAVYYCARVKGYYYYIDVWGKGTTVTVSS

SEQ ID NO: 12320 - protein, 123 aa, Homo sapiens
EVQLLESGGGLVQPGGSLRLSCAASGFTFSWYRMNWVRQAPGKGLEWVSSIYSSGGPTNYADSVKGRFTISRDNSQNTLYLQMNSLRAEDTAVYYCTREKPDYYDSSGYLDYWGQGTLVTVSS

SEQ ID NO: 12321 - protein, 116 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRDTAMGVWGQGTLVTVSS

SEQ ID NO: 12322 - protein, 117 aa, Artificial Sequence
  Description of Artificial Sequence: Synthetic polypeptide
  Synthetic Construct
DVQLQESGPGLVKPSQSLSLTCTVTGYSITSDYVWNWIRQFPGNKLEWMGYIGHSGRTSYNPSLKSRISITRDTSKNQFFLQLNSVTSEDTATYYCARGGNNGFAYWGQGTLVTVSA

SEQ ID NO: 12323 - protein, 115 aa, Artificial Sequence
  Description of Artificial Sequence: Synthetic polypeptide
  Synthetic Construct
EVMVVESGGGLVKPGGSLKLSCAASGFTFRTNAMSWVRQTPEKRLEWVATITSGGGSTYYPVSVKGRFTISRDNAKNTLYLQMSSLRSEDTAIYYCVRQDYFDYWGQGTFVIVSS

SEQ ID NO: 12324 - protein, 122 aa, Artificial Sequence
  Description of Artificial Sequence: Synthetic polypeptide
  Synthetic Construct
  MOD_RES (20)..(20): Any amino acid
DVKLVESGGGLVKPGGSLKXSCVASGFTFSSYTMSWVRQTPEKRLEWVATITSGGGSSYYPDSVKGRFTISRDNAKNTLYLQITSLKSEDTAMYYCTSGGGVLLRLPLFAYWGQGTTLTVSS

SEQ ID NO: 12325 - protein, 119 aa, Artificial Sequence [sequence omitted]

SEQ ID NO: 12326 - protein, 122 aa, Artificial Sequence
  Description of Artificial Sequence: Synthetic polypeptide
  Synthetic Fab-13 VH protein sequence
QVQLKESGPALVKPTQTLTLTCTFSGFSLSTSGMVVSWIRQPPGKALEWLAFISWDDDKYYSTSLKTRLTISKDTSKNQVVLTMTNMDPVDTATYYCAREPGRYGGYYFDYWGQGTLVTVSS

SEQ ID NO: 12327 - protein, 122 aa, Artificial Sequence
  Description of Artificial Sequence: Synthetic polypeptide
  Synthetic Fab-28 VH protein sequence
QVQLQESGPGLVKPGETLSLTCTVSGGSISGYYWSWIRQAPGKGLEWIGEIYYAGSTLYNPSLKGRVTISVDTSKNQFSLKLSSVTAEDTAVYYCARHYGLDWFGDTGMDVWGQGTLVTVSS

SEQ ID NO: 12328 - protein, 109 aa, Artificial Sequence
  Description of Artificial Sequence: Synthetic polypeptide
  Synthetic Fab-21 VL protein sequence
DIELTQPPSVSVAPGQTARISCSGDNLGEQYVHWYQQKPGQAPVLVIYDDSERPSGIPERFSGSNSGNTATLTISGTQAEDEADYYCQSYTFYPNSRVFGGGTKLTVLG

SEQ ID NO: 12329 - protein, 123 aa, Artificial Sequence
  Description of Artificial Sequence: Synthetic polypeptide
QVQLVQSGGGLVKPGRSLRLSCTASGFTFGDYAMSWFRQAPGKGLEWVGFIRSKAYGGTTEYAASVKGRFTISRDDSKSIAYLQMNSLKTEDTAVYYCTRGSSGWFLNWFDPWGQGTLVTVSS

SEQ ID NO: 12330 - protein, 119 aa, mus sp.
EVQLQESGPELVKPGASVKMSCKASGYTFPSYVLHWVKQKPGQGLEWIGYINPYNDGTQYNEKFKGKATLTSDKSSSTAYMELSRLTSEDSAVYYCARGFGGSYGFAYWGQGTLITVSA

SEQ ID NO: 12331 - protein, 119 aa, Artificial Sequence
  Description of Artificial Sequence: Synthetic polypeptide
QVQLQESGPELVKPGASVKMSCKASGYTFPSYVLHWVKQKPGQGLEWIGYINPYNDGTQYNEKFKGKATLTSDKSSSTAYMELSRLTSEDSAVYYCARGFGGSYGFAYWGQGTLITVSS

SEQ ID NO: 12332 - protein, 107 aa, Homo sapiens
VQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPRLLADVLL

SEQ ID NO: 12333 - protein, 11 aa, Homo sapiens
WGQGTLVTVSS

SEQ ID NO: 12334 - protein, 119 aa, Artificial Sequence
  Description of Artificial Sequence: Synthetic polypeptide
QVQLQQSGAEVKKPGASVKVSCEASGYTFPSYVLHWVKQAPGQGLEWIGYINPYNDGTQYNEKFKGKATLTRDTSINTAYMELSRLRSDDTAVYYCARGFGGSYGFAYWGQGTLVTVSS

SEQ ID NO: 12335 - protein, 123 aa, Homo sapiens
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSS

SEQ ID NO: 12336 - protein, 449 aa, Homo sapiens
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 12337 - protein, 453 aa, Homo sapiens
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12338 - protein, 450 aa, Homo sapiens
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 12339 - protein, 125 aa, Homo sapiens
EVQLVQSGAEVKKPGESLKISCKGSGYNFTTYWIGWVRQMPGKGLEWMGIIYPGDSDTKYSPSFQGQVTISADKSISTAYLQWSSLKASDTAMYYCARNYYGSGTYYYYYGMNVWGQGTTVTVSS

SEQ ID NO: 12340 - protein, 127 aa, Homo sapiens
EVQLVESGGGLVQPGRSLRLSCTASGFTFEDYAMHWVRQAPGKGLEWVSGISWNRGIIGYADSVKGRFTVSRDNAKNSLYLQMNSLRAEDTALYYCAKEGYYGSGRPGYFYYVMDVWGQGTTVTVSS

SEQ ID NO: 12341 - protein, 127 aa, Homo sapiens
EVQLVESGGGLVQPGRSLRLSCAASGFIFDDYAMHWVRQAPGKGLEWVSGISWNRGIIGYAGSVKGRFTISRDNAKNSLYLQMNSLRAEDTALYYCVKEGYYGSGRPGYFYYVMDVWGQGTTVTVSS

SEQ ID NO: 12342 - protein, 121 aa, Homo sapiens
EVQLVESGGGLVQPGRSLRLSCAASGFIFDDYAMHWVRQAPGKGLEWVSGITWNSGILGYADSVKGRFTISRDDAKNSLYLQMNSLRAEDTALYYCAKEEGSGRYYNFDYWGQGTLVTVSS

SEQ ID NO: 12343 - protein, 124 aa, Homo sapiens
EVQLVESGGGVVRPGGSLRLSCAASGFTFDDYGMNWVRQAPGKGLEWVSDINWNGGSTGYADSVKGRFTISRDNAKNSLYLQMNSLRAEDTALYYCAREQWLDPYYYYYGMDVWGQGTTVTVSS

SEQ ID NO: 12344 - protein, 107 aa, Homo sapiens
EIVLTQSPATLSLSPGERATLSCRASQGVSSYLAWYQQKPGQAPRLLIYDASNRATGIPARFSGSGPGTDFTLTISSLEPEDFAVYYCQQRSNWHRTFGQGTKVEIK

SEQ ID NO: 12345 - protein, 116 aa, Artificial Sequence
  Description of Artificial Sequence: Synthetic polypeptide
QVQLQQWGAGLLKPSETLSLTCAVYGGSFSDYYWSWIRQPPGKGLEWIGEINHTGSTNYNPSLKSRVTISVDTSQNHFSLKLRSVTAADTALYYCAREEVIWFDSWGQGTLVTVSS

SEQ ID NO: 12346 - protein, 122 aa, Artificial Sequence
  Description of Artificial Sequence: Synthetic polypeptide
EVQLVESGGGLVQPGGSLRLSCAASGFTFSSYDIHWVRQATGKGLEWVSAIGAAGDTYYSGSVKGRFTISRENAKNSLYLEMNKLRAGDTAVYYCAREGTGTTNYYYGMDVWGQGTTVTVSS

SEQ ID NO: 12347 - protein, 122 aa, Artificial Sequence
  Description of Artificial Sequence: Synthetic polypeptide
EVQLVESGGGLVQPGGSLRLSCAASGFTFRAYDMHWVRQTAGKGLEWVSAIGSAGDTYYSGSVKGRFTISRENAKKSLYLQMNSLRAGDTAVYFCAREATGTTNYYYGMDVWGQGTTVTVSS

SEQ ID NO: 12348 - protein, 122 aa, Artificial Sequence
  Description of Artificial Sequence: Synthetic polypeptide
EVQLVESGGGLIQPGGSLRLSCAASGFTFSNFDMHWVRQATGKGLEWVAAIGSAGDTYYPDSVRGRFTISRENAKNSLFLQMNSLRDGDTAVYYCAREGTGTTNYYYGMDVWGQGTTVTVSS

SEQ ID NO: 12349 - protein, 122 aa, Artificial Sequence
  Description of Artificial Sequence: Synthetic polypeptide
EVQLVESGGGLEQPGGSLRLSCVASGFTFSNYDMHWVRQATGKGLEWVSAIGAAGDTYYSGSVKGRFTIARENGKNSLYLQMNGLRAGDTAVYYCAREGTGTTNYYYGMDVWGQGTTVTVSS

SEQ ID NO: 12350 - protein, 119 aa, Artificial Sequence
  Description of Artificial Sequence: Synthetic polypeptide
QVQLVQSGAEVKKPGASVKVSCKVSGFTLTELSMHWVRQAPGKGLEWMGGFDPEDGETIYAQKFQGRVTMTEDTSTDTAYMELSSLRSEDTAVYYCSTIFGVVTNFDNWGQGTLVTVSS

SEQ ID NO: 12351 - protein, 119 aa, Artificial Sequence [sequence omitted]

SEQ ID NO: 12352 - protein, 119 aa, Artificial Sequence
  Description of Artificial Sequence: Synthetic polypeptide
EVQLVQSGAEVKKPGASVKVSCKVSGYTLTELSIHWVRQAPGKGLEWMGGFDPEHGTTIYAQKFQGRVTMTEDTSTDTAYMELSSLRSEDTAVYYCVMIFGVVTNFDNWGQGTTVTVSS

SEQ ID NO: 12353 - protein, 119 aa, Artificial Sequence
  Description of Artificial Sequence: Synthetic polypeptide
QVQLVQSGAEVKKPGASVKVSCKVSGYTLTELSMHWVRQAPGKGLEWMGGFDPEHGTTIYAQKFQGRVTMTEDTSTDTAYMELSSLRSEDTAVYYCVMIFGVVTNFDNWGQGTLVTVSS

SEQ ID NO: 12354 - protein, 119 aa, Artificial Sequence
  Description of Artificial Sequence: Synthetic polypeptide
QVQLVQSGAEVKKPGASVKVSCKVSGYTLTELSIHWVRQAPGKGLEWMGGFDPEHGTTIYAQKFQGRVTMTEDTSTDTAYMELSSLRSEDTAVYYCVMIFGVVTNFDNWGQGTLVTVSS

SEQ ID NO: 12355 - protein, 119 aa, Artificial Sequence
  Description of Artificial Sequence: Synthetic polypeptide
EVQLVQSGAEVKKPGASVKVSCKVSGFTLTELSIHWVRQAPGKGLEWMGGFDPEDGETIYAQKFQGRVTMTEDTSTDTACMELSSLRSEDTAVYYCSTIFGVVTNFDNWGQGTLVTVSS

SEQ ID NO: 12356 - protein, 119 aa, Artificial Sequence
  Description of Artificial Sequence: Synthetic polypeptide
QVQLVQSGAEVKKPGASVKVSCKVSGFTLTELSIHWVRQAPGKGLEWMGGFDPEDGETIYAQKFQGRVTMTEDTSTDTACMELSSLRSEDTAVYYCSTIFGVVTNFDNWGQGTLVTVSS

SEQ ID NO: 12357 - protein, 119 aa, Artificial Sequence
  Description of Artificial Sequence: Synthetic polypeptide
EVQLVQSGAEVKKPGASVKVSCKVSGFTLNELSIHWVRQAPGKGLEWMGGFDPEDGEVIYAQKFQGRVTMTEDTSTDTAYMELRSLRSEDTAVFYCVMIFGVVTNFDNWGQGTTVTVSS

SEQ ID NO: 12358 - protein, 119 aa, Artificial Sequence
  Description of Artificial Sequence: Synthetic polypeptide
QVQLVQSGAEVKKPGASVKVSCKVSGFTLNELSMHWVRQAPGKGLEWMGGFDPEDGEVIYAQKFQGRVTMTEDTSTDTAYMELSSLRSEDTAVYYCVMIFGVVTNFDNWGQGTLVTVSS

SEQ ID NO: 12359 - protein, 119 aa, Artificial Sequence
  Description of Artificial Sequence: Synthetic polypeptide
QVQLVQSGAEVKKPGASVKVSCKVSGFTLNELSIHWVRQAPGKGLEWMGGFDPEDGEVIYAQKFQGRVTMTEDTSTDTAYMELRSLRSEDTAVFYCVMIFGVVTNFDNWGQGTLVTVSS

SEQ ID NO: 12360 - protein, 119 aa, Artificial Sequence
  Description of Artificial Sequence: Synthetic polypeptide
EVQLVQSGTEVKKPGASVKVSCKVSGYTLTELSMYWVRQAPGKGLEWMGGFDPEHGETIYAQKFQGRVTMTEDSSTDTAYMELSSLRSEDTAVYYCAMIFGVVTNFDSWGLGTLVTVSS

SEQ ID NO: 12361 - protein, 119 aa, Artificial Sequence
  Description of Artificial Sequence: Synthetic polypeptide
QVQLVQSGAEVKKPGASVKVSCKVSGYTLTELSMHWVRQAPGKGLEWMGGFDPEHGETIYAQKFQGRVTMTEDTSTDTAYMELSSLRSEDTAVYYCAMIFGVVTNFDSWGQGTLVTVSS

SEQ ID NO: 12362 - protein, 119 aa, Artificial Sequence
  Description of Artificial Sequence: Synthetic polypeptide
QVQLVQSGTEVKKPGASVKVSCKVSGYTLTELSMYWVRQAPGKGLEWMGGFDPEHGETIYAQKFQGRVTMTEDSSTDTAYMELSSLRSEDTAVYYCAMIFGVVTNFDSWGLGTLVTVSS

SEQ ID NO: 12363 - protein, 125 aa, Artificial Sequence
  Description of Artificial Sequence: Synthetic polypeptide
EVQLVQSGGGLVQPGRSLRLSCAAPGFNFDDYAMHWVRQTPGKGLEWVSGISWNSGTIGYADSVKGRFTISRDNAKNSLYLQMNSLRPEDTALYYCAKEGVWFGKLFSSYGMDVWGQGTTVTVSS

SEQ ID NO: 12364 - protein, 125 aa, Artificial Sequence
  Description of Artificial Sequence: Synthetic polypeptide
EVQLVESGGGLVQPGRSLRLSCAAPGFNFDDYAMHWVRQAPGKGLEWVSGISWNSGTIGYADSVKGRFTISRDNAKNSLYLQMNSLRAEDTALYYCAKEGVWFGKLFSSYGMDVWGQGTTVTVSS

SEQ ID NO: 12365 - protein, 125 aa, Artificial Sequence
  Description of Artificial Sequence: Synthetic polypeptide
EVQLVESGGGLVQPGRSLRLSCAASGFNFDDYAMHWVRQAPGKGLEWVSGISWNSGTIGYADSVKGRFTISRDNAKNSLYLQMNSLRAEDTALYYCAKEGVWFGKLFSSYGMDVWGQGTTVTVSS

SEQ ID NO: 12366 - protein, 125 aa, Artificial Sequence
  Description of Artificial Sequence: Synthetic polypeptide
EVQLVESGGGLVQPGRSLRLSCAAPGFNFDDYAMHWVRQTPGKGLEWVSGISWNSGTIGYADSVKGRFTISRDNAKNSLYLQMNSLRPEDTALYYCAKEGVWFGKLFSSYGMDVWGQGTTVTVSS

SEQ ID NO: 12367 - protein, 125 aa, Artificial Sequence
  Description of Artificial Sequence: Synthetic polypeptide
EVQLVESGGGLVQPGRSLRLSCAASGFNFDDYAMHWVRQTPGKGLEWVSGISWNSGTIGYADSVKGRFTISRDNAKNSLYLQMNSLRPEDTALYYCAKEGVWFGKLFSSYGMDVWGQGTTVTVSS

SEQ ID NO: 12368 - protein, 119 aa, Artificial Sequence
  Description of Artificial Sequence: Synthetic polypeptide
EVQLVQSGAEVRKPGASVKVSCKVSGYTLTELSIHWVRQAPGKGLEWMGGFDPEDGETIYAQKFQGRVIMTEDTSTDTAYMELSSLRSEDTAVYYCVMIFGVVTNFDNWGQGTLVTVSS

SEQ ID NO: 12369 - protein, 119 aa, Artificial Sequence
  Description of Artificial Sequence: Synthetic polypeptide
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCVMIFGVVTNFDNWGQGTLVTVSS

SEQ ID NO: 12370 - protein, 119 aa, Artificial Sequence
  Description of Artificial Sequence: Synthetic polypeptide
QVQLVQSGAEVRKPGASVKVSCKVSGYTLTELSIHWVRQAPGKGLEWMGGFDPEDGETIYAQKFQGRVIMTEDTSTDTAYMELSSLRSEDTAVYYCVMIFGVVTNFDNWGQGTLVTVSS

SEQ ID NO: 12371 - protein, 119 aa, Artificial Sequence
  Description of Artificial Sequence: Synthetic polypeptide
EVQLVQSGAEVKKPGASVKVSCKVSGFTLTELSIHWVRQAPGKGLEWMGGFDPEDGETIYAQKFQGRVTMTEDTSTDTAYMELSSLRSEDTAVYYCSTIFGVVTNFDNWGQGTLVTVSS

SEQ ID NO: 12372 - protein, 119 aa, Artificial Sequence
  Description of Artificial Sequence: Synthetic polypeptide
QVQLVQSGAEVKKPGASVKVSCKVSGFTLTELSIHWVRQAPGKGLEWMGGFDPEDGETIYAQKFQGRVTMTEDTSTDTAYMELSSLRSEDTAVYYCSTIFGVVTNFDNWGQGTLVTVSS

SEQ ID NO: 12373 - protein, 125 aa, Artificial Sequence
  Description of Artificial Sequence: Synthetic polypeptide
EVQLVQSGGGSVQPGRSLRLSCAASGFTFDDYSMHWVRQGPGKGLEWVSGISWNSGTIVYADSVKGRFTISRDNVKNTLYLQMKSLRDEDTAVYYCAKEGVWFGRLFSSYGMDVWGQGTLVTVSS

SEQ ID NO: 12374 - protein, 125 aa, Artificial Sequence
  Description of Artificial Sequence: Synthetic polypeptide
EVQLVESGGGLVQPGRSLRLSCAASGFTFDDYSMHWVRQAPGKGLEWVSGISWNSGTIGYADSVKGRFTISRDNAKNSLYLQMNSLRAEDTALYYCAKEGVWFGRLFSSYGMDVWGQGTTVTVSS

SEQ ID NO: 12375 - protein, 125 aa, Artificial Sequence
  Description of Artificial Sequence: Synthetic polypeptide
EVQLVESGGGSVQPGRSLRLSCAASGFTFDDYSMHWVRQGPGKGLEWVSGISWNSGTIVYADSVKGRFTISRDNVKNTLYLQMKSLRDEDTAVYYCAKEGVWFGRLFSSYGMDVWGQGTTVTVSS

SEQ ID NO: 12376 - protein, 125 aa, Artificial Sequence
  Description of Artificial Sequence: Synthetic polypeptide
QVQLVQSGGGLVQPGRSLKLSCAASRFTFEDYAMHWVRQAPGKGLEWVSGISWNSGSIGYADSVKGRFTISRDNAKNSLYLRMNSLRADDTALYYCVKEGVWFGKLFSSYGLDVWGQGTTVTVSS

SEQ ID NO: 12377 - protein, 125 aa, Artificial Sequence
  Description of Artificial Sequence: Synthetic polypeptide
EVQLVESGGGLVQPGRSLRLSCAASRFTFEDYAMHWVRQAPGKGLEWVSGISWNSGSIGYADSVKGRFTISRDNAKNSLYLQMNSLRAEDTALYYCVKEGVWFGKLFSSYGLDVWGQGTTVTVSS

SEQ ID NO: 12378 - protein, 125 aa, Artificial Sequence
  Description of Artificial Sequence: Synthetic polypeptide
EVQLVESGGGLVQPGRSLKLSCAASRFTFEDYAMHWVRQAPGKGLEWVSGISWNSGSIGYADSVKGRFTISRDNAKNSLYLRMNSLRADDTALYYCVKEGVWFGKLFSSYGLDVWGQGTTVTVSS

SEQ ID NO: 12379 - protein, 125 aa, Artificial Sequence
  Description of Artificial Sequence: Synthetic polypeptide
EVQLVQSGGGLVQPGRSLRLSCAAPGFNFDDYAMHWVRQAPGKGLEWVSGISWNSGSIGYADSVKGRFTISRDNAKNSLYLQMNSLRAEDTALYYCAKEGVWFGKLFSSYGMDVWGQGTTVTVSS

SEQ ID NO: 12380 - protein, 125 aa, Artificial Sequence
  Description of Artificial Sequence: Synthetic polypeptide
EVQLVESGGGLVQPGRSLRLSCAASGFNFDDYAMHWVRQAPGKGLEWVSGISWNSGSIGYADSVKGRFTISRDNAKNSLYLQMNSLRAEDTALYYCAKEGVWFGKLFSSYGMDVWGQGTTVTVSS

SEQ ID NO: 12381 - protein, 125 aa, Artificial Sequence
  Description of Artificial Sequence: Synthetic polypeptide
EVQLVESGGGLVQPGRSLRLSCAAPGFNFDDYAMHWVRQAPGKGLEWVSGISWNSGSIGYADSVKGRFTISRDNAKNSLYLQMNSLRAEDTALYYCAKEGVWFGKLFSSYGMDVWGQGTTVTVSS

SEQ ID NO: 12382 - protein, 125 aa, Artificial Sequence
  Description of Artificial Sequence: Synthetic polypeptide
EVQLVQSGGGLVQPGRSLRLSCAASGFTFDDYAMHWVRQGPGKGLEWVSGISWNSGSIGYADSVKGRFTISRDNAKNSLYLQMNSLRAEDTALYYCAKEGVWFGELFSSYGMDVWGQGTLVTVSS

SEQ ID NO: 12383 - protein, 125 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKEGVWFGELFSSYGMDVWGQGTTVTVSS

SEQ ID NO: 12384 - protein, 125 aa, Artificial Sequence
  Description of Artificial Sequence: Synthetic polypeptide
EVQLVESGGGLVQPGRSLRLSCAASGFTFDDYAMHWVRQGPGKGLEWVSGISWNSGSIGYADSVKGRFTISRDNAKNSLYLQMNSLRAEDTALYYCAKEGVWFGELFSSYGMDVWGQGTTVTVSS

SEQ ID NO: 12385 - protein, 125 aa, Artificial Sequence
  Description of Artificial Sequence: Synthetic polypeptide
QVQLVQSGGGLVQPGRSLRLSCAASGFTFDDYAMHWVRQGPGKGLEWVSGISWNSGSIGYADSVKGRFTISRDNAKNSLYLQMNSLRAEDTALYYCAKEGVWFGELFSSYGMDVWGQGTTVTVSS

SEQ ID NO: 12386 - protein, 119 aa, Artificial Sequence
  Description of Artificial Sequence: Synthetic polypeptide
EVQLVQSGAEVKKPGASVKVSCKVSGFTLTELSIHWVRQAPGKGLEWMGGFDPEDGETISAQKFQGRVTMTEDTSTDTAYMELSSLRSEDTAIYYCSTIFGVVTNFDNWGQGTTVTVSS

SEQ ID NO: 12387 - protein, 119 aa, Artificial Sequence
  Description of Artificial Sequence: Synthetic polypeptide
QVQLVQSGAEVKKPGASVKVSCKVSGFTLTELSIHWVRQAPGKGLEWMGGFDPEDGETISAQKFQGRVTMTEDTSTDTAYMELSSLRSEDTAIYYCSTIFGVVTNFDNWGQGTLVTVSS

SEQ ID NO: 12388 - protein, 125 aa, Artificial Sequence
  Description of Artificial Sequence: Synthetic polypeptide
QVQLVQSGGGLVQPGRSLRLSCAAPGFNFDDYAMHWVRQTPGKGLEWVSGISWNSGTIGYADSVKGRFTISRDNAKNSLYLQMNSLRAEDTALYYCAKEGVWFGKLFSSYGMDVWGQGTTVTVSS

SEQ ID NO: 12389 - protein, 125 aa, Artificial Sequence
  Description of Artificial Sequence: Synthetic polypeptide
EVQLVQSGGGLVQPGGSLRLSCAAPGFNFDDYAMHWVRQAPGKGLEWVSGISWNSGSIGYADSVKGRFTISRDNAKNSLYLQMNSLRAEDSALYFCAKEGVWFGKLFSSYGMDVWGQGTTVTVSS

SEQ ID NO: 12390 - protein, 125 aa, Artificial Sequence
  Description of Artificial Sequence: Synthetic polypeptide
EVQLVESGGGLVQPGGSLRLSCAAPGFNFDDYAMHWVRQAPGKGLEWVSGISWNSGSIGYADSVKGRFTISRDNAKNSLYLQMNSLRAEDSALYFCAKEGVWFGKLFSSYGMDVWGQGTTVTVSS

SEQ ID NO: 12391 - protein, 125 aa, Artificial Sequence
  Description of Artificial Sequence: Synthetic polypeptide
QVQLVQSGGGLVQPGRSLRLSCAASGFTFDDYAMHWVRQGPGKGLEWVSGISWNSGYKDYADSVKGRFTISRDNAKKSLYLQMNSLRPEDTALYYCAKEGVWFGELFSSYGMDVWGQGTTVTVSS

SEQ ID NO: 12392 - protein, 125 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGYKGYADSVKGRFTISRDNAKNSLYLQMNSLRAEDTALYYCAKEGVWFGELFSSYGMDVWGQGTTVTVSS

SEQ ID NO: 12393 - protein, 125 aa, Artificial Sequence
  Description of Artificial Sequence: Synthetic polypeptide
EVQLVESGGGLVQPGRSLRLSCAASGFTFDDYAMHWVRQGPGKGLEWVSGISWNSGYKDYADSVKGRFTISRDNAKKSLYLQMNSLRPEDTALYYCAKEGVWFGELFSSYGMDVWGQGTTVTVSS

SEQ ID NO: 12394 - protein, 125 aa, Artificial Sequence
  Description of Artificial Sequence: Synthetic polypeptide
EVQLVQSGGGLVQPGRSLRLSCTASKFTFEDYAMHWVRQVPGKGLEWVSGISWNSGNIGYADSVKGRFTISRDNAKNSLYLRMNSLRADDTALYYCVKEGVWFGKSFSSYGLDVWGQGTTVTVSS

SEQ ID NO: 12395 - protein, 125 aa, Artificial Sequence
  Description of Artificial Sequence: Synthetic polypeptide
EVQLVESGGGLVQPGRSLRLSCAASKFTFEDYAMHWVRQAPGKGLEWVSGISWNSGNIGYADSVKGRFTISRDNAKNSLYLQMNSLRAEDTALYYCVKEGVWFGKSFSSYGLDVWGQGTTVTVSS

SEQ ID NO: 12396 - protein, 125 aa, Artificial Sequence
  Description of Artificial Sequence: Synthetic polypeptide
EVQLVESGGGLVQPGRSLRLSCTASKFTFEDYAMHWVRQVPGKGLEWVSGISWNSGNIGYADSVKGRFTISRDNAKNSLYLRMNSLRADDTALYYCVKEGVWFGKSFSSYGLDVWGQGTTVTVSS

SEQ ID NO: 12397 - protein, 119 aa, Artificial Sequence
  Description of Artificial Sequence: Synthetic polypeptide
EVQLVQSGADVKKPGASVKVSCKVSGYTLTELSIHWVRQAPGKGLEWMGGFDPEHGTTIYAQKFQGRVTMTEDTSTDTAYMELSSLRSEDTAVYYCVMIFGVVTNFDNWGQGTTVTVSS

SEQ ID NO: 12398 - protein, 119 aa, Artificial Sequence
  Description of Artificial Sequence: Synthetic polypeptide
QVQLVQSGADVKKPGASVKVSCKVSGYTLTELSIHWVRQAPGKGLEWMGGFDPEHGTTIYAQKFQGRVTMTEDTSTDTAYMELSSLRSEDTAVYYCVMIFGVVTNFDNWGQGTLVTVSS

SEQ ID NO: 12399 - protein, 123 aa, Artificial Sequence
  Description of Artificial Sequence: Synthetic polypeptide
AVQLVESGGGLVQPGRSLKLSCTASGFTFSSFAMAWVRQAPTKGLEWVASISYGGADTYYRDSVKGRFTISRDNAKSSLYLQMDSLRSEDTSTYYCAKDLPYYGYTPFVMDAWGQGTSVTVSS

SEQ ID NO: 12400 - protein, 119 aa, Artificial Sequence
  Description of Artificial Sequence: Synthetic polypeptide
EVQLVESGGGLVQPGRSLKVSCLASGFTFSHYGMNWIRQAPGKGLDWVASISRSGSYIRYVDTVKGRFTVSRDIAKNTLYLQMTSLRSEDTALYYCAREGQFGDYFEYWGQGVMVTVSS

SEQ ID NO: 12401 - protein, 119 aa, Artificial Sequence
  Description of Artificial Sequence: Synthetic polypeptide
EVQLVESGGGLVQPGRSLKLSCLASGFTFSHYGVNWIRQAPGKGLEWIASISRSSSYIYYADTVKGRFTISRDNAKNTLFLQLTSLRSEDTALYYCAREGQFGDYFEYWGRGVMVTVSS

SEQ ID NO: 12402 - protein, 119 aa, Artificial Sequence
  Description of Artificial Sequence: Synthetic polypeptide
EVQLVESGGGLVQPGRSLKLSCLASGFTFSHYGMNWIRQAPGKGLEWITSITSSSSYIYYADTVKGRFTISRDNAKNTLYLQMTSLRSEDTALYYCAREGQFGDYFDYWGQGVMVTVSS

SEQ ID NO: 12403 - protein, 116 aa, Artificial Sequence
  Description of Artificial Sequence: Synthetic polypeptide
QVQVKESGPGLVQPSQTLSLTCTVSGFSLTSYHVSWVRQPPGKGLEWMGAIWTGGSTAYNSLLKSRLSISRDISKSQVFLKMNSLQTEDTATYYCARADFYVMDAWGQGASVTVSS

SEQ ID NO: 12404 - protein, 123 aa, Artificial Sequence
  Description of Artificial Sequence: Synthetic polypeptide
EVQLVESGGGLVQPGGSLRLSCAASGFTFSSFAMAWVRQAPGKGLEWVASISYGGADTYYRDSVKGRFTISRDNAKNSLYLQMNSLRAEDTAVYYCARDLPYYGYTPFVMDAWGQGTLVTVSS

SEQ ID NO: 12405 - protein, 123 aa, Artificial Sequence
  Description of Artificial Sequence: Synthetic polypeptide
EVQLVESGGGLVQPGGSLRLSCAASGFTFSSFAMAWVRQAPGKGLEWVASISYGGADTYYRDSVKGRFTISRDNAKNSLYLQMNSLRAEDTAVYYCAKDLPYYGYTPFVMDAWGQGTLVTVSS

SEQ ID NO: 12406 - protein, 453 aa, Artificial Sequence
  Description of Artificial Sequence: Synthetic polypeptide
EVQLVESGGGLVQPGGSLRLSCAASGFTFSSFAMAWVRQAPGKGLEWVASISYGGADTYYRDSVKGRFTISRDNAKNSLYLQMNSLRAEDTAVYYCAKDLPYYGYTPFVMDAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12407 - protein, 119 aa, Artificial Sequence
  Description of Artificial Sequence: Synthetic polypeptide
EVQLVESGGGLVQPGGSLRLSCAASGFTFSHYGMNWVRQAPGKGLEWVASISRSGSYIRYVDTVKGRFTISRDNAKNSLYLQMNSLRAEDTAVYYCAREGQFGDYFEYWGQGTLVTVSS

SEQ ID NO: 12408 - protein, 449 aa, Artificial Sequence
  Description of Artificial Sequence: Synthetic polypeptide
EVQLVESGGGLVQPGGSLRLSCAASGFTFSHYGMNWVRQAPGKGLEWVASISRSGSYIRYVDTVKGRFTISRDNAKNSLYLQMNSLRAEDTAVYYCAREGQFGDYFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12409 - protein, 127 aa, Homo sapiens
QLQLQESGPGLVKPSETLSLTCTVSGGSINSSSYYWGWLRQSPGKGLEWIGSFFYTGSTYYNPSLRSRLTISVDTSKNQFSLMLSSVTAADTAVYYCARQSTYYYGSGNYYGWFDRWDQGTLVTVSS

SEQ ID NO: 12410 - protein, 130 aa, Homo sapiens
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSS

SEQ ID NO: 12411 - protein, 120 aa, Artificial Sequence
  Description of Artificial Sequence: Synthetic polypeptide
QVHLQQPGAELVKPGASVKLSCKASGYTFTSYWMYWVKQGPGRGLEWIGRIDPNSGSTKYNEKFKNKATLTVDKSSSTAYMQLSSLTSEDSAVYYCARDYRKGLYAMDYWGQGTSVTVSS

SEQ ID NO: 12412 - protein, 120 aa, Artificial Sequence
  Description of Artificial Sequence: Synthetic polypeptide
EVQLQQSGAELVKPGASVKLSCKASGYTFTSYWMYWVKQGPGRGLEWIGRIDPNSGSTKYNEKFKNKATLTVDKSSSTAYMQLSSLTSEDSAVYYCARDYRKGLYAMDYWGQGTTVTVSS

SEQ ID NO: 12413 - protein, 120 aa, Artificial Sequence
  Description of Artificial Sequence: Synthetic polypeptide
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSS

SEQ ID NO: 12414 - protein, 113 aa, Artificial Sequence
  Description of Artificial Sequence: Synthetic polypeptide
EVQLQQSGAELVKPGASVKLSCKASGYTFTSYWMYWVKQGPGRGLEWIGRIDPNSGSTKYNEKFKNKATLTVDKSSSTAYMQLSSLTSEDSAVYYCARDYRKGLYAMDYWGQG

SEQ ID NO: 12415 - protein, 113 aa, Artificial Sequence
  Description of Artificial Sequence: Synthetic polypeptide
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQG

SEQ ID NO: 12416 - protein, 113 aa, Artificial Sequence
  Description of Artificial Sequence: Synthetic polypeptide
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQG

SEQ ID NO: 12417 - protein, 113 aa, Artificial Sequence
  Description of Artificial Sequence: Synthetic polypeptide
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQG

SEQ ID NO: 12418 - protein, 113 aa, Artificial Sequence
  Description of Artificial Sequence: Synthetic polypeptide
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQG

SEQ ID NO: 12419 - protein, 113 aa, Artificial Sequence
  Description of Artificial Sequence: Synthetic polypeptide
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQG

SEQ ID NO: 12420 - protein, 113 aa, Artificial Sequence
  Description of Artificial Sequence: Synthetic polypeptide
EVQLVQSGAEVKKPGESLRISCKGSGYTFTSYWMYWVRQARGQRLEWIGRIDPNSGSTKYNEKFKNRLTISKDTSKNQVVLTMTNMDPVDTATYYCARDYRKGLYAMDYWGQG

SEQ ID NO: 12421 - protein, 113 aa, Artificial Sequence
  Description of Artificial Sequence: Synthetic polypeptide
EVQLVQSGAEVKKPGATVKISCKVSGYTFTSYWMYWIRQSPSRGLEWLGRIDPNSGSTKYNEKFKNRLTISKDTSKNQVVLTMTNMDPVDTATYYCARDYRKGLYAMDYWGQG

SEQ ID NO: 12422 - protein, 113 aa, Artificial Sequence
  Description of Artificial Sequence: Synthetic polypeptide
QITLKESGPTLVKPTQTLTLTCTFSGYTFTSYWMYWVRQAPGKGLEWVSRIDPNSGSTKYNEKFKNRVTITADKSTSTAYMELSSLRSEDTAVYYCARDYRKGLYAMDYWGQG

SEQ ID NO: 12423 - protein, 113 aa, Artificial Sequence
  Description of Artificial Sequence: Synthetic polypeptide
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQG

SEQ ID NO: 12424 - protein, 117 aa, Artificial Sequence
  Description of Artificial Sequence: Synthetic polypeptide
EVQLLESGGGLVQPGGSLRLSCAASGFTFSSYAMSWVRQAPGKGLEWVSGIGSYGGGTYYADSVKGRFTISRDNSKNTLYLQMNSLRAEDTAVYYCARYVNFGMDYWGQGTLVTVSS

SEQ ID NO: 12425 - protein, 116 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARRVWGFDYWGQGTLVTVSS

SEQ ID NO: 12426 - protein, 128 aa, Artificial Sequence
  Description of Artificial Sequence: Synthetic polypeptide
  MOD_RES (120)..(120): Any amino acid
  MOD_RES (124)..(125): Any amino acid
EVRLQQSGADLVKPGASVKLSCASGFIIKATYMHWVRQRPEQGLEWIGRIDPANGEKYDPKFQVKAITADTSSSTAYLQLNSLTSDDTAVYYCARYAWYFDVWGAGTTVTVSSAKTTPPXVYPXXPGS

SEQ ID NO: 12427 - protein, 446 aa, Artificial Sequence
  Description of Artificial Sequence: Synthetic polypeptide
EVQLVESGGDLVQPGGSLRLSCAASGFTFSSYWMSWVRQAPGKGLEWVANIKQDGSEKYYVDSVKGRFTISRDNAKNSLYLQMNSLRAEDTAVYYCARDRGSLYYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12428 - protein, 124 aa, Artificial Sequence
  Description of Artificial Sequence: Synthetic polypeptide
QVQLQQSGPGLVKPSQTLSLTCAISGDSVSSNSAAWGWIRQSPGRGLEWLGRIYYRSKWYNSYAVSVKSRITINPDTSKNQFSLQLNSVTPEDTAVYYCARYDWVPKIGVFDSWGQGTLVTVSS

SEQ ID NO: 12429 - protein, 454 aa, Artificial Sequence
  Description of Artificial Sequence: Synthetic polypeptide
QVQLQQSGPGLVKPSQTLSLTCAISGDSVSSNSAAWGWIRQSPGRGLEWLGRIYYRSKWYNSYAVSVKSRITINPDTSKNQFSLQLNSVTPEDTAVYYCARYDWVPKIGVFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12430 - protein, 112 aa, Mus musculus
DVQLQESGPGLVKPSQSLSLTCTVTGFSITTEYAWNWIRQFPGNRLEWMGYIGYTGRTNYSPSLKSRISITRDTSKNQFFLQLNSVTTEDTATYYCTRMDYWGQGTSVTVSS

SEQ ID NO: 12431 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTNYAPSLKSRITISVDTSKNQFSLQLSSVTAEDTATYYCARMDYWGQGTLVTVSS

SEQ ID NO: 12432 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTYYSPSLKSRITISVDTSKNQFSLQLSSVTAEDTATYYCARMDYWGQGTLVTVSS

SEQ ID NO: 12433 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTSYSPSLKSRITISVDTSKNQFSLQLSSVTAEDTATYYCARMDYWGQGTLVTVSS

SEQ ID NO: 12434 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTGYSPSLKSRITISVDTSKNQFSLQLSSVTAEDTATYYCARMDYWGQGTLVTVSS

SEQ ID NO: 12435 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTSYAPSLKSRITISVDTSKNQFSLQLSSVTAEDTATYYCARMDYWGQGTLVTVSS

SEQ ID NO: 12436 - protein, 112 aa, Artificial Sequence
  Description of Artificial Sequence: Synthetic polypeptide
QVQLQESGPGLVKPSQTLSLTCTVSGGSISTEYAWNWIRQPPGKGLEWIGYIGYTGRTGYAPSLKSRITISVDTSKNQFSLQLSSVTAEDTATYYCARMDYWGQGTLVTVSS

SEQ ID NO: 12437 - protein, 130 aa, Mus musculus
MRVLILLWLFTAFPGILSDVQLQESGPGLVKPSQSLSLTCTVTGFSITTEYAWNWIRQFPGNRLEWMGYIGYTGRTNYSPSLKSRISITRDTSKNQFFLQLNSVTTEDTATYYCTRMDYWGQGTSVTVSS

SEQ ID NO: 12438 - protein, 113 aa, Homo sapiens
VKLQESGPELKKPGETVKISCKASGYTFTNYGMNWVKQAPGKGLKWMGWINTYTGEPTYADDFKGRFAFSLETSASTAYLQINNLKNEDTATYFCARPWFAYWGQGTTVTVSS

SEQ ID NO: 12439 - protein, 115 aa, Artificial Sequence
  Description of Artificial Sequence: Synthetic polypeptide
QVQLVQSGAEVKKPGASVKVSCKASGYTFTDHAIHWVRQAPGQRLEWMGYFSPGNDDFKYSQKFQGRVTITADKSASTAYMELSSLRSEDTAVYYCARSLNMAYWGQGTLVTVSS

SEQ ID NO: 12440 - protein, 115 aa, Artificial Sequence
  Description of Artificial Sequence: Synthetic polypeptide
QVQLVQSGAEVKKPGASVKVSCKASGYTFTDHAIHWVRQAPGQRLEWMGYFSPGNDDFKYSQKFQGRVTITADKSASTAYMELSSLRSEDTAVYYCARSLVQGYWGQGTLVTVSS

SEQ ID NO: 12441 - protein, 115 aa, Artificial Sequence
  Description of Artificial Sequence: Synthetic polypeptide
QVQLVQSGAEVKKPGASVKVSCKASGYTFTDHAIHWVRQAPGQRLEWMGYFSPGNDDFKYSQKFQGRVTITADKSASTAYMELSSLRSEDTAVYYCARSLIQGYWGQGTLVTVSS

SEQ ID NO: 12442 - protein, 115 aa, Artificial Sequence
  Description of Artificial Sequence: Synthetic polypeptide
QVQLVQSGAEVKKPGASVKVSCKASGYTFTDHAIHWVRQAPGQRLEWMGYFSPGNDDFKYSQKFQGRVTITADKSASTAYMELSSLRSEDTAVYYCARSWIMQYWGQGTLVTVSS

SEQ ID NO: 12443 - protein, 115 aa, Artificial Sequence
  Description of Artificial Sequence: Synthetic polypeptide
QVQLVQSGAEVKKPGASVKVSCKASGYTFTDHAIHWVRQAPGQRLEWMGYFSPGNDDFKYSQKFQGRVTITADKSASTAYMELSSLRSEDTAVYYCARSLVMAYWGQGTLVTVSS

SEQ ID NO: 12444 - protein, 115 aa, Artificial Sequence
  Description of Artificial Sequence: Synthetic polypeptide
QVQLVQSGAEVKKPGASVKVSCKASGYTFTDHAIHWVRQAPGQRLEWMGYFSPGNDDFKYSQKFQGRVTITADKSASTAYMELSSLRSEDTAVYYCARSLIMAYWGQGTLVTVSS

SEQ ID NO: 12445 - protein, 116 aa, Mus musculus
  144-1 VH
VQLQESGPGLAKPSQTLSLTCSVTGYSITSDYWNWIRKFPGNKLEYMGYISYSGSTYYNPSLKSRISITRDTSKNQYYLQLNSVTTEDTATYYCARSYDGICFDNWGQGTTLTVSS

SEQ ID NO: 12446 - protein, 116 aa, Mus musculus
  MBL184-6 VH
EVQLQQSGAELVRPGASVKLSCTVSGFNIKDDYMHWVKQRPEQGLEWIGRIDPANGHTKYAPKFQDKATITADTSSNTAYLQFSSLTSEDTAVYYCTRMGLRRGYWGQGTTLTVSS

SEQ ID NO: 12447 - protein, 114 aa, Mus musculus
  MBL259-3 VH
VQLQQSGAELVRPGASVKLSCTASDFNIKDDYMHWMKQRPEQGLEWIGRIDPANGNTKYAPKFQDKATMTADTSSNTAYLQFSSLTSEDTAVYYCATSWGFPYWGQGTLVTVSA

SEQ ID NO: 12448 - protein, 115 aa, Mus musculus
  MBL292-1 VH
VQLQQSGAELVRPGASVKLSCTASGFNIKDDYMHWMKQRPEQGLEWIGRIDPANGNTKYAPKFQDKATITADTSSNTAYLQLSSLTSEDTAVYYCSRMGLLRGYWGQGTTLTVSS

SEQ ID NO: 12449 - protein, 115 aa, Mus musculus
  MBL352-34 VH
VQLQQSGAELVRPGASVKLSCTASGFNIKDDYMHWVKQRPEQGLEWIGRIDPANGHTKYAPKFQDKATITADTSSNTAYLQFSSLTSEDTAVYYCTRMGLRRGYWGQGTTLTVSS

SEQ ID NO: 12450 - protein, 107 aa, Mus musculus
DIQMTQTTSSLSASLGDRLTISCRASQDIRNYLNWYQQKPDGTVKLLIYYTSRLHSGVPSRFSGSGSGTDYSLTISNLEQEDIATYFCQQGNTLPWTFGGGTKLEIK

SEQ ID NO: 12451 - protein, 112 aa, Mus musculus
VQLQQSGAELVRPGASVKLSCTASGFNIKDDYMYWVKQRPEQGLEWIGRIDPANGNTKYAPKFQDKATITADTSSNTAYLHLSSLTSEDTAVFYCAYRRAYWGQGTLVTVSA

SEQ ID NO: 12452 - protein, 106 aa, Mus musculus
IVMTQTPKLLPVSAGDRVTMTCKASQSVDNSVAWYQQKPGQSPKLLIFYASNHYTGVPDRFTASGSGTDFTFTISSVQVEDLAVYFCQQHFSSPRTFGGGTKLEIR

SEQ ID NO: 12453 - protein, 115 aa, Mus musculus
EVQLQQSGTVLTRPGASVKMSCKASGYTFTNFWIHWVKQRPGQGLDWIGAIYPGNTNTDYNQKFQGKAKLTAVSSASTAYMELSSLTNEDSAVYYCTRGGAMDYWGQGTSVTVSS

SEQ ID NO: 12454 - protein, 125 aa, Homo sapiens
QVQLVESGGGVVQPGRSLRLSCAASGFTFSSYDIHWVRQAPGKGLEWVAVIWYDGSIKYYADSVKGRFTISRDNSKNTLYLQMNSLRAEDTAVYYCAREEQLVRGGYYYYGMDVWGQGTTVTVSS

SEQ ID NO: 12455 - protein, 128 aa, Homo sapiens
QVQLQESGPGLVKPSQTLSLTCTVSGGSISSGGYYWSWIRQHPGKGLEWIGNIYYSGSTYYNPSLKSRVTISVDTSKNQFSLKLSSVTAADTAVYYCARDSNQYNWNDEVYDYGLDVWGQGTTVTVSS

SEQ ID NO: 12456 - protein, 123 aa, Homo sapiens
QVQLVESGGGVVQPGRSLRLSCAASGFTFSNYGMHWVRQAPGKGLEWVTIISYDGSNKYYADSVKGRFTISRDNSKNTLYLQMNSLRAEDTAVYYCVTYYDFWSGYLPGMDVWGQGTTVTVSS

SEQ ID NO: 12457 - protein, 117 aa, Homo sapiens
QVQLQESGPGLVKPSETLSLTCTVSGGSINHYYWSWIRQPAGKGLEWIGRIYPTGSTNYNPSLKSRVTMSVDTSKNQFSLKLSSVTAADTAVYYCAGGWSYWYFDLWGRGTLVTVSS

SEQ ID NO: 12458 - protein, 123 aa, Homo sapiens
QVQLVESGGGVVQPGRSLRLSCAASGFTFSNYDMHWVRQAPGKGLEWVAVIWYDGSIKYYADSVKGRFTISRDNSKNTLHLQMNSLRAEDTAVYYCAREIAVAGGYYYGLDVWGQGTTVTVSS

SEQ ID NO: 12459 - protein, 128 aa, Homo sapiens
QVQLQESGPGLVKPSQTLSLTCTVSGGSISSGGYYWSWIRQHPGKGLEWIGNIYYSGSTYYTPSLKSRVTISVDTSKNQFSLKLSSVTAADTAVYYCARDSNQYNWNDEVYDYGLDVWGQGTTVTVSS

SEQ ID NO: 12460 - protein, 122 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDQDNWNYYYGMDVWGQGTTVTVSS

SEQ ID NO: 12461 - protein, 124 aa, Homo sapiens
QVQLVESGGGVVQPGRSLRLSCAASGFTFSNYDMHWVRQAPGKGLEWVAVIWYDGSIKYYADSVKGRFTISRDNSKNTLYLQMNSLRAEDTAVYFCARETAILRGYYYYDMDVWGQGTTVTVSS

SEQ ID NO: 12462 - protein, 124 aa, Homo sapiens
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSS

SEQ ID NO: 12463 - protein, 115 aa, Homo sapiens
EVQLVESGGGLIQPGGSLRLSCAASGFTVSSNYMSWVRQAPGKGLEWVSVIYSGDRTYYADSVKGRFTISRDNSKNTLYLQMNSLRAEDTAVYYCARGEGGFDYWGQGTLVTVSS

SEQ ID NO: 12464 - protein, 115 aa, Homo sapiens
EVQLVESGGGLIQPGGSLRLSCAASGFTVSRNYMSWVRQAPGKGLEWVSVIYSGDRTYYADSVKGRFTISRDNSKNTLYLQMNSLRAEDTAVYYCARGEGGFDYWGQGTLVTVSS

SEQ ID NO: 12465 - protein, 115 aa, Homo sapiens
EVQLVESGGGLIQPGGSLRLSCAASEFTVSRNYMSWVRQAPGKGLEWVSVIYSGDRTYYADSVKGRFTISRDNSKNTLYLQMNSLRAEDTAVYYCARGEGGFDYWGQGTLVTVSS

SEQ ID NO: 12466 - protein, 125 aa, Homo sapiens
QVQLVESGGGVVQPGRSLRLSCAASGFTVSSYGMHWVRQAPGKGLEWVAVIWSNGSNKYYADSVKGRFTISRDNSKNTLYLQMNSLRAEDTAVYYCARDNGVYVGYAYYYGMDVWGQGTTVTVSS

SEQ ID NO: 12467 - protein, 128 aa, Homo sapiens
QVQLVESGGSVVQPGRSLRLSCAASGFTFSNYGIHWVRQAPGKGLEWVAVIWSDGSNKYYADSVKGRFTISRDNSKNTLYLQMNSLRAEDTAVYYCARELPNSGSYSGYYYYYGMDVWGQGTTVTVSS

SEQ ID NO: 12468 - protein, 125 aa, Homo sapiens
QVQLVESGGGVVQPGRSLRLSCAASGFTFSSYDMHWVRQAPGKGLEWVAVIWSDGSIKYYADSVKGRFTISRDNSKNTLYLQMNSLRAEDTAVYYCAREVESAMGGFYYNGMDVWGQGATVTVSS

SEQ ID NO: 12469 - protein, 125 aa, Homo sapiens
QVQLVESGGGVVQPGRSLRLSCAASGFTFSSYDMHWVRQAPGKGLEWVAVIWSDGSIKYYADSVKGRFTISRDNSKNTLYLQMNSLRAEDTAVYYCAREVESAMGGFYYNGMDVWGQGTTVTVSS

SEQ ID NO: 12470 - protein, 107 aa, Homo sapiens
DIQMTQSPSSLSASVGDRVTITCRASQGIRNDLGWYQQKPGKAPKRLIYAASSLESGVPSRFSGSGSGPEFTLTISSLQPEDFATYYCLQHNSYPLTFGGGTKVEIQ

SEQ ID NO: 12471 - protein, 113 aa, Oryctolagus cuniculus
DVVMTQTPASVEAAVGGTVTIKCQASENIDILLAWYQQKVGQPPKLLIYRASKLASGAPSRFSGSGSGTEFTLTISDLECGDAATYYCQSNVGSTARSSYGNAFGGGTEVVVK

SEQ ID NO: 12472 - protein, 110 aa, Homo sapiens
QSVLTQPPSVSAAPGQKVTISCSGSSSNIGNNYVSWYQQFPGTAPKLLIYDNNSRPSGIPDRFSGSKSGTSATLGITGLQTGDEADYYCGTWDSSLSAGVFGGGTKLTVL

SEQ ID NO: 12473 - protein, 110 aa, Homo sapiens
QSALTQPPSVSAAPGQKVTISCSGSSSNIGSNYVSWCQQLPRTAPKLLIYDNNKRPSGIPDRFSGSKSGTSATLVITGLQTGDEADYYCGAWDSSLSAGVFGGGTKLTVL

SEQ ID NO: 12474 - protein, 108 aa, Homo sapiens
SSELTQDPAVSVALGQTVRITCQGDSLRSYYASWYQQRPGQAPVLVIYGRNNRPSGIPDRFSGSSSGLTASLTVTGAQAEDEADYYCNSRDSSYNHVAFGGGTKLTVL

SEQ ID NO: 12475 - protein, 108 aa, Homo sapiens
SSELTQDPAVSVALGQTVRITCQGDSLRIYYASWYQQKPGQAPVLVIYGKNNRPSGIPDRFSGSSSGNTASLTVTGAQAEDEADYYCKSRDSSFNHVTFGGGTKLTVL

SEQ ID NO: 12476 - protein, 111 aa, Homo sapiens
QSLLTQPPSVSGAPGQRVTISCTGSSSNIGAGYDVHWYQQFPGTAPKLLIYGNSNRPSGVPDRFSGSKSGTSASLAITGLQAEDEADYYCQSYDSSLSGSVFGGGTKLTVL

SEQ ID NO: 12477 - protein, 107 aa, Homo sapiens
SSELTQDPAVSVALGQTVRITCQGDSLRNYYASWYQQKPGQAPILVIYGKNNRPSGIPDRFSGSSSGNTASLTITGAQAEDEADYYCNSRDSSGNHLVFGGGTKLTV

SEQ ID NO: 12478 - protein, 111 aa, Homo sapiens
QSVLTQSPSVSGAPGQRVTISCTGSSSNIGAGYDVHWYQQLPGTAPRLLIYGNNNRPSGVPDRFSGSKSGTSASLAITGLQAEDEADYYCQSYDSSLSGSVFGGGTKLTVL

SEQ ID NO: 12479 - protein, 108 aa, Homo sapiens
SSELTQDPAVSVALGQTVRITCQGDSLRRYYASWYQQKPGQAPIVVIYGKKNRPSGIPDRFSGSSSGNTASLTITGAQAEDEADYYCKSRDSSGNHLVFGGGTKLTVL

SEQ ID NO: 12480 - protein, 107 aa, Homo sapiens
DIQMTQSPSSVSASVGDRVTITCRASQGISSWLAWYQQKPGKAPKLLIYAASSLQSGVPSRFSGSGSGTDFTLTISSLQPEDFASYYCQQANSFPWTFGQGTKVEIK

SEQ ID NO: 12481 - protein, 107 aa, Homo sapiens
DIQMTQSPSSLSASVGDRVTITCRASQGIRNDLGWYQQKPGKAPKRLIYAASSLQSGVPSRFSGSGSGTEFTLTVSSLQPEDFATYYCLQHNSLPLTFGGGTKVEIK

SEQ ID NO: 12482 - protein, 106 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCHQCDNLPHFGQGTRLEIK

SEQ ID NO: 12483 - protein, 107 aa, Homo sapiens
DIQMTQSPSSLSASVGDRVTITCRASQAIRNDLGWYQQKPGKAPKRLIYAASSLQSGVPSRFSGSRSGTEFTLTISSLQPEDFASYYCLQHRSYPLTFGGGTKVEIK

SEQ ID NO: 12484 - protein, 107 aa, Homo sapiens
EIVMTQSPSTLSVSPGERATLSCRASQSVSSNLAWYQQKPGQAPRLLIYGASIRATGIPARFSGSGSGTEYTLTISSLQSEDFAVYYCQQYNNWPFTFGPGTKVDIK

SEQ ID NO: 12485 - protein, 107 aa, Homo sapiens
DIQMTQSPSSLSASVGDRVAITCRTSQSISSYLNWYQQKPGKAPELLIYAASNLQSGVPSRFSGSGSGTDFTLTISSLQPEDFATYYCQQSSSTLITFGQGTRLEIK

SEQ ID NO: 12486 - protein, 107 aa, Homo sapiens
EIVMTQSPATLSVSPGERATLSCRASQSVSSNLAWYQQKPGQAPRLLIYGASTRATGIPARFSGSRTGTEFTLTISSLQSEDFAVYYCQQYNNWPLTFGGGTKVEIK

SEQ ID NO: 12487 - protein, 107 aa, Homo sapiens
DIQMTQSPSSLSASVGDRVTITCRTSQSISSYLNWYHQKPGKAPELLIYAAFNLQSGVPSRFSGSGSGTDFTLTISSLQPEDFATYYCQQSSSTLITFGQGTRLEIK

SEQ ID NO: 12488 - protein, 108 aa, Homo sapiens
SYELTQPPSVSVSPGQTARITCSGDALPKKYVYWYQQKSGQAPVLVIYEDSKRPSGIPERFSGSSSGTMATLTINGAQVEDEADYYCYSTDSSGNHVVFGGGTKLTVL

SEQ ID NO: 12489 - protein, 123 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGGITGTTNYYGMDVWGQGTTVTVSS

SEQ ID NO: 12490 - protein, 125 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARAPLWTVRSWYYYGMDVWGQGTTVTVSS

SEQ ID NO: 12491 - protein, 116 aa, Homo sapiens
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSS

SEQ ID NO: 12492 - protein, 117 aa, Homo sapiens
QVQLVQSGAEVKKPGASVKVSCKASGYTFTFYSITWVRQAPGQGLEWMGWISAYNDNTNYAQKLQGRVTMTTDTSTSTAYMELRSLRSDDTAVYYCARTFTSGFDYWGQGTLVTVSS

SEQ ID NO: 12493 - protein, 118 aa, Homo sapiens
QVQLQESGPGLVKPSETLSLTCTVSGGSISSYYWSWIRQPPGKGLEWIGYFYYSGSTNYNPSLKSRVTISVDTSKNQFSLKLRSVTAADTAVYYCARDRFTSGWFDYWGQGTLVTVSS

SEQ ID NO: 12494 - protein, 115 aa, Homo sapiens
EVQLVESGGGLIQPGGSLRLSCAASGFTVSNNYMHWVRQAPGKGLEWVSVIYSGGNTYYADSVKGRFTISRDNSKNTLFLQMNSLKTEDTAVYYCARGPGAFDIWGQGTMVTVSS

SEQ ID NO: 12495 - protein, 115 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGPGAFDIWGQGTMVTVSS

SEQ ID NO: 12496 - protein, 121 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREGDYGGNPYFDYWGQGTLVTVSS

SEQ ID NO: 12497 - protein, 121 aa, Homo sapiens
QVHLVESGGGVVQPGRSLRLSCAASGFTFSSYGMHWVRQAPGKGLEWVAVIWHDGSNKYYADSVKGRFTISRDNSKNTLYLQMNSLRAEDTAVYYCTREGDYGGYPYFDYWGQGTLVTVSS

SEQ ID NO: 12498 - protein, 122 aa, Homo sapiens
QVQLVESGGGVVQPGRSLRLSCAASGFTFSSYGMHWVRQAPGKGLEWVAIIWYDGSNEYYGDSVKGRFTISRDNSKNTLFLQMNSLRAEDTAVYYCARDPLRIVVAGDFDYWGQGTLVTVSS

SEQ ID NO: 12499 - protein, 125 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARETTVTKEGYYYYGMDVWGQGTTVTVSS

SEQ ID NO: 12500 - protein, 120 aa, Homo sapiens
QVQLVESGGGVVQPGRSLRLSCAASGFTFSTYGMHWVRQAPGKGLEWVAVIWYDGSNKYYADSVKGRFTISRDNSKNTLYLQMNSLRAEDTAVYYCARSRYGDWGWFDPWGQGTLVTVSS

SEQ ID NO: 12501 - protein, 125 aa, Homo sapiens
QVQLVESGGGVVQPGRSLRLSCAASGFTFSSYDMHWVRQAPGKGLEWVAIISYDGSIKYYADSVKGRFTISRDNSKNTLYLQMNSLRAEDTAVYYCARENAVTYGGYYHYGMDVWGQGTTVTVSS

SEQ ID NO: 12502 - protein, 125 aa, Homo sapiens
QVQLVESGGGVVQPGRSLRLSCTTSGFTFSNYGMHWVRQAPGKGLEWVAVIWYDGSIKYYVDSVKGRFTISRDNSKNTLYLQMNSLRAEDTAVYYCAREKDCGGDCYSHYGMDVWGQGTTVTVSS

SEQ ID NO: 12503 - protein, 134 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGNRVVVAGTRVTPANWGYYYYGMDVWGQGTTVTVSS

SEQ ID NO: 12504 - protein, 116 aa, Homo sapiens
EVQLVESGGGLVQPGGSLRLSCAASGFTFSNYGMNWVRQAPGKGLEWVSYISNSITSKYYADSVKGRFTISRDNAKNSLYLQMNSLRDVDTAVYHCARGPGGFDYWGQGTLVTVSS

SEQ ID NO: 12505 - protein, 122 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDYYDSSGYHPFDYWGQGTLVTVSS

SEQ ID NO: 12506 - protein, 125 aa, Homo sapiens
QVQLVESGGGVVQPGRSLRLSCAASGFTFSSYDMHWVRQAPGKGLEWVAVIWYDGSNKYHADSVKGRFTISRDNSKNTLYLQMNSLRAEDTAVYYCARENTMVRGGDYYYGMDVWGQGTTVTVSS

SEQ ID NO: 12507 - protein, 122 aa, Homo sapiens
QVQLVESGGGVVQPGRSLRLSCAASGFTFSSYGMHWVRQAPGKGLEWVAVIWYDGRNKYNADSVKGRFTISRDNSKNTLNLQMNSLRAEDTAVYYCARDLTYYDILGGMDVWGQGTTVTVSS

SEQ ID NO: 12508 - protein, 135 aa, Mus musculus
MEWSGVFIFLLSVTADVHSQVQLQQSGPELVRPGTSVRISCKASGYTFTIYWLGWVKQRPGHGLEWIGNIFPGSAYINYNEKFKGKATLTADTSSSTAYMQLSSLTSEDSAVYFCAREGSNSGYWGQGTTLTVSS

SEQ ID NO: 12509 - protein, 116 aa, Mus musculus
QVQLVQSGAEVKKPGASVKVSCKASGYTFTIYWLGWVRQAPGQGLEWMGNIFPGSAYINYNEKFKGRVTITADTSTSTAYMELSSLRSEDTAVYYCAREGSNSGYWGQGTLVTVSS

SEQ ID NO: 12510 - protein, 116 aa, Artificial Sequence
  Description of Artificial Sequence: Synthetic polypeptide
  Synthetic HV3a sequence
QVQLVQSGPEVKKPGASVKVSCKASGYTFTIYWLGWVRQAPGQGLEWMGNIFPGSAYINYNEKFKGKVTITADTSTSTAYMELSSLRSEDTAVYFCAREGSNSGYWGQGTLVTVSS

SEQ ID NO: 12511 - protein, 116 aa, Artificial Sequence
  Description of Artificial Sequence: Synthetic polypeptide
  Synthetic HV4 sequence
QVQLVQSGPEVKKPGASVKVSCKASGYTFTIYWLGWVKQAPGQGLEWIGNIFPGSAYINYNEKFKGRVTITADTSTSTAYMELSSLRSEDTAVYFCAREGSNSGYWGQGTLVTVSS

SEQ ID NO: 12512 - protein, 116 aa, Artificial Sequence
  Description of Artificial Sequence: Synthetic polypeptide
  Synthetic HV5 sequence
QVQLVQSGAEVKKPGASVKVSCKASGYTFTIYWLGWVKQAPGQGLEWIGNIFPGSAYINYNEKFKGKATITADTSTSTAYMELSSLRSEDTAVYFCAREGSNSGYWGQGTLVTVSS

SEQ ID NO: 12513 - protein, 116 aa, Artificial Sequence
  Description of Artificial Sequence: Synthetic polypeptide
  Synthetic HV10 sequence
QVQLVQSGPEVVKPGASVKISCKASGYTFTIYWLGWVKQAPGQGLEWIGNIFPGSAYINYNEKFKGKATLTADTSTSTAYMELSSLRSEDTAVYFCAREGSNSGYWGQGTLLTVSS

SEQ ID NO: 12514 - protein, 449 aa, Artificial Sequence; identical to SEQ ID NO: 5159
  Description of Artificial Sequence: Synthetic polypeptide

SEQ ID NO: 12515 - protein, 113 aa, Artificial Sequence
  Description of Artificial Sequence: Synthetic polypeptide
LVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSS

SEQ ID NO: 12516 - protein, 123 aa, Artificial Sequence [sequence omitted]

SEQ ID NO: 12517 - protein, 127 aa, Artificial Sequence
  Description of Artificial Sequence: Synthetic polypeptide
  Synthetic polypeptide for heavy chain variable region of an anti-VEGF antibody
EVQLLESGGGLVQPGGSLRLSCAASGFTFSGYAMSWVRQAPGKGLEWVSSIYSSSGSKYYADSVKGRFTISRDNSKNTLYLQMNSLRAEDTAVYYCARASSTCTRTWCSYDDAMDVWGQGTLVTVSS

SEQ ID NO: 12518 - protein, 121 aa, Artificial Sequence
  Description of Artificial Sequence: Synthetic polypeptide
  Synthetic polypeptide for heavy chain variable region of an anti-VEGF antibody
EVQLLESGGGLVQTGGSLRLSCAASGFTFSDYAMSWVRQAPGKGLEWVSSIYPGSGSKYYADSVKGRFAISRDNSKNTLYLQMNSLRAEDTAVYYCARDAWFRGHNVFDYWGQGTLVTVSS

SEQ ID NO: 12519 - protein, 127 aa, Artificial Sequence
  Description of Artificial Sequence: Synthetic polypeptide
  Synthetic polypeptide for heavy chain variable region of an anti-VEGF antibody
EVQLLESGGGLVQPGGSLRLSCAASGFTFSNYDMSWVRQAPGKGLEWVSGIYPNGGSKYYADSVKGRFTISRDNSKNTLYLQMNSLRAEDTAVYYCARALRQCQRYWCSYADGMDVWGQGTLVTVSS

SEQ ID NO: 12520 - protein, 121 aa, Artificial Sequence
  Description of Artificial Sequence: Synthetic polypeptide
  Synthetic polypeptide for heavy chain variable region of an anti-VEGF antibody
EVQLLESGGGLVQPGGSLRLSCAASGFTFSDYYMSWVRQAPGKGLEWVSAIYSGGGSIYYADSVKGRFTISRDNSKNTLYLQMNSLRAEDTAVYYCARDVQWNKAPRFDYWGQGTLVTVSS

SEQ ID NO: 12521 - protein, 121 aa, Artificial Sequence
  Description of Artificial Sequence: Synthetic polypeptide
  Synthetic polypeptide for heavy chain variable region of an anti-VEGF antibody
EVQLLESGGGLVQPGGSLRLSCAASGFTFSSYSMSWVRQAPGKGLEWVSGISHGGGNKYYADSVKGRFTISRDNSKNTLYLQMNSLRAEDTAVYYCARDLRANNDTGFDYWGQGTLVTVSS

SEQ ID NO: 12522 - protein, 127 aa, Artificial Sequence
  Description of Artificial Sequence: Synthetic polypeptide
  Synthetic polypeptide for heavy chain variable region of an anti-VEGF antibody
EVQLLESGGGLVQPGGSLRLSCAASGFTFSNYDMSWVRQAPGKGLEWVSLISHGGGNIYYADSVKGRFTISRDNSKNTLYLQMNSLRAEDTAVYYCARVPVMCTNHWCSYANGMDVWGQGTLVTVSS

SEQ ID NO: 12523 - protein, 121 aa, Artificial Sequence
  Description of Artificial Sequence: Synthetic polypeptide
  Synthetic polypeptide for heavy chain variable region of an anti-VEGF antibody
EVQLLESGGGLVQPGGSLRLSCAASGFTFSGYAMSWVRQAPGKGLEWVSGISHDGGNTYYADSVKGRFTISRDNSKNTLYLQMNSLRAEDTAVYYCARDRRKGPSTEFDYWGQGTLVTVSS

SEQ ID NO: 12524 - protein, 127 aa, Artificial Sequence
  Description of Artificial Sequence: Synthetic polypeptide
  Synthetic polypeptide for heavy chain variable region of an anti-VEGF antibody
EVQLLESGGGLVQTGGSLRLSCAASGFTFSDYAMSWVRQAPGKGLEWVSWIYPGDSSIYYADSVKGRFTISRDNSKNTLYLQMNSLRAEDTAVYYCARLLSIDQAQLHYYYDAMDVWGQGTLVTVSS

SEQ ID NO: 12525 - protein, 122 aa, Homo sapiens; identical to SEQ ID NO: 5368

SEQ ID NO: 12526 - protein, 118 aa, Mus musculus
EVQLQQSGAELVKPGASVKLSCTASGFNIKDTYIHWVKQRPEQGLEWVGRIDPATGNTRYDPKFQGKATITADTSSNTAYLQLSSLTSEDTAVYYCASFRPGYALDYWGQGTSVTVSS

SEQ ID NO: 12527 - protein, 251 aa, Artificial Sequence
  Description of Artificial Sequence: Synthetic polypeptide
  recombinant immunoglobulin
MKKNIAFLLASMFVFSIATNAYAEVQLVESGGGLVPPGGSLKLSCAASGFIFSSYGMSWVRQTPGKSLELVATINNNGDSTYYPDSVKGRFTISRDNAKNTLYLQMSSLKSEDTAMFYCARALISSATWFGYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 12528 - protein, 81 aa, Artificial Sequence
  Description of Artificial Sequence: Synthetic polypeptide
  Sequence is synthesized
QVQLVQSGAEVKKPGASVKVSCKASWVRQAPGQGLEWMRVTITADTSTSTAYMELSSLRSEDTAVYYCARWGQGTLVTVSS

SEQ ID NO: 12529 - protein, 80 aa, Artificial Sequence
  Description of Artificial Sequence: Synthetic polypeptide
  Sequence is synthesized
QVQLVQSGAEVKKPGASVKVSCKASWVRQAPGQGLEWMRVTITADTSTSTAYMELSSLRSEDTAVYYCAWGQGTLVTVSS

SEQ ID NO: 12530 - protein, 79 aa, Artificial Sequence
  Description of Artificial Sequence: Synthetic polypeptide
  Sequence is synthesized
QVQLVQSGAEVKKPGASVKVSCKASWVRQAPGQGLEWMRVTITADTSTSTAYMELSSLRSEDTAVYYCWGQGTLVTVSS

SEQ ID NO: 12531 - protein, 87 aa, Artificial Sequence
  Description of Artificial Sequence: Synthetic polypeptide
  Sequence is synthesized
QVQLQESGPGLVKPSQTLSLTCTVSGGSVSWIRQPPGKGLEWIGRVTISVDTSKNQFSLKLSSVTAADTAVYYCARWGQGTLVTVSS

SEQ ID NO: 12532 - protein, 81 aa, Artificial Sequence
  Description of Artificial Sequence: Synthetic polypeptide
  Sequence is synthesized
QVQLQESGPGLVKPSQTLSLTCTVSWIRQPPGKGLEWIRVTISVDTSKNQFSLKLSSVTAADTAVYYCARWGQGTLVTVSS

SEQ ID NO: 12533 - protein, 80 aa, Artificial Sequence
  Description of Artificial Sequence: Synthetic polypeptide
  Sequence is synthesized
QVQLQESGPGLVKPSQTLSLTCTVSWIRQPPGKGLEWIRVTISVDTSKNQFSLKLSSVTAADTAVYYCAWGQGTLVTVSS

SEQ ID NO: 12534 - protein, 79 aa, Artificial Sequence
  Description of Artificial Sequence: Synthetic polypeptide
  Sequence is synthesized
QVQLQESGPGLVKPSQTLSLTCTVSWIRQPPGKGLEWIRVTISVDTSKNQFSLKLSSVTAADTAVYYCWGQGTLVTVSS

SEQ ID NO: 12535 - protein, 87 aa, Artificial Sequence
  Description of Artificial Sequence: Synthetic polypeptide
  Sequence is synthesized
EVQLVESGGGLVQPGGSLRLSCAASGFTFSWVRQAPGKGLEWVSRFTISRDNSKNTLYLQMNSLRAEDTAVYYCARWGQGTLVTVSS

SEQ ID NO: 12536 - protein, 81 aa, Artificial Sequence
  Description of Artificial Sequence: Synthetic polypeptide
  Sequence is synthesized
EVQLVESGGGLVQPGGSLRLSCAASWVRQAPGKGLEWVRFTISRDNSKNTLYLQMNSLRAEDTAVYYCARWGQGTLVTVSS

SEQ ID NO: 12537 - protein, 80 aa, Artificial Sequence
  Description of Artificial Sequence: Synthetic polypeptide
  Sequence is synthesized
EVQLVESGGGLVQPGGSLRLSCAASWVRQAPGKGLEWVRFTISRDNSKNTLYLQMNSLRAEDTAVYYCAWGQGTLVTVSS

SEQ ID NO: 12538 - protein, 79 aa, Artificial Sequence
  Description of Artificial Sequence: Synthetic polypeptide
  Sequence is synthesized
EVQLVESGGGLVQPGGSLRLSCAASWVRQAPGKGLEWVRFTISRDNSKNTLYLQMNSLRAEDTAVYYCWGQGTLVTVSS

SEQ ID NO: 12539 - protein, 87 aa, Artificial Sequence
  Description of Artificial Sequence: Synthetic polypeptide
  Sequence is synthesized
EVQLVESGGGLVQPGGSLRLSCAASGFNIKWVRQAPGKGLEWVSRFTISADTSKNTAYLQMNSLRAEDTAVYYCSRWGQGTLVTVSS

SEQ ID NO: 12540 - protein, 81 aa, Artificial Sequence
  Description of Artificial Sequence: Synthetic polypeptide
  Sequence is synthesized
EVQLVESGGGLVQPGGSLRLSCAASWVRQAPGKGLEWVRFTISADTSKNTAYLQMNSLRAEDTAVYYCSRWGQGTLVTVSS

SEQ ID NO: 12541 - protein, 80 aa, Artificial Sequence
  Description of Artificial Sequence: Synthetic polypeptide
  Sequence is synthesized
EVQLVESGGGLVQPGGSLRLSCAASWVRQAPGKGLEWVRFTISADTSKNTAYLQMNSLRAEDTAVYYCSWGQGTLVTVSS

SEQ ID NO: 12542 - protein, 87 aa, Artificial Sequence
  Description of Artificial Sequence: Synthetic polypeptide
  Sequence is synthesized
EVQLVESGGGLVQPGGSLRLSCAASGFNIKWVRQAPGKGLEWVSRFTISADTSKNTAYLQMNSLRAEDTAVYYCARWGQGTLVTVSS

SEQ ID NO: 12543 - protein, 81 aa, Artificial Sequence
  Description of Artificial Sequence: Synthetic polypeptide
  Sequence is synthesized
EVQLVESGGGLVQPGGSLRLSCAASWVRQAPGKGLEWVRFTISADTSKNTAYLQMNSLRAEDTAVYYCARWGQGTLVTVSS

SEQ ID NO: 12544 - protein, 80 aa, Artificial Sequence
  Description of Artificial Sequence: Synthetic polypeptide
  Sequence is synthesized
EVQLVESGGGLVQPGGSLRLSCAASWVRQAPGKGLEWVRFTISADTSKNTAYLQMNSLRAEDTAVYYCAWGQGTLVTVSS

SEQ ID NO: 12545 - protein, 79 aa, Artificial Sequence
  Description of Artificial Sequence: Synthetic polypeptide
  Sequence is synthesized
EVQLVESGGGLVQPGGSLRLSCAASWVRQAPGKGLEWVRFTISADTSKNTAYLQMNSLRAEDTAVYYCWGQGTLVTVSS

SEQ ID NO: 12546 - protein, 449 aa, Homo sapiens
EVQLLESGGGLVQPGGSLRLSCAASGFTFSSFPMAWVRQAPGKGLEWVSTISTSGGRTYYRDSVKGRFTISRDNSKNTLYLQMNSLRAEDTAVYYCAKFRQYSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12547 - protein, 119 aa, Artificial Sequence
  Description of Artificial Sequence: Synthetic polypeptide
  Heavy chain variable region without signal sequence, H7
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSS

SEQ ID NO: 12548 - protein, 119 aa, Artificial Sequence
  Description of Artificial Sequence: Synthetic polypeptide
  Heavy chain variable region without signal sequence, H2
QVQLVQSGAEVKKPGASVKISCKASGYSFTAYYIHWVKQAPGQGLEWIGYISCYNGATNYNQKFKGRVTFTTDTSTSTAYMELRSLRSDDTAVYYCARDYDYDVGMDYWGQGTLVTVSS

SEQ ID NO: 12549 - protein, 119 aa, Artificial Sequence
  Description of Artificial Sequence: Synthetic polypeptide
  Heavy chain variable region without signal sequence, H9
QVQLVQSGAEVKKPGASVKISCKASGYSFTAYYIHWVKQAPGQGLEWIGYISVYNGATNYNQKFKGRVTFTTDTSTSTAYMELRSLRSDDTAVYYCARDYDYDVGMDYWGQGTLVTVSS

SEQ ID NO: 12550 - protein, 123 aa, Artificial Sequence
  Description of Artificial Sequence: Synthetic polypeptide
  Variable domain
QLQLVESGGGMAQPGGSLKLSCAASGFTFDDYAMTWVRQAPGKGLEWLSTISWNDINTYYAESMKDRFTISRDNAKNTLYLQMNSLESEDTAVYYCAKRRDNYYGTSGEYDYWGQGTQVTVSS

SEQ ID NO: 12551 - protein, 118 aa, Artificial Sequence
  Description of Artificial Sequence: Synthetic polypeptide
  Variable domain
QVQLQESGGDLVQPGGSLRLSCAASGFTFDDYVMNWVRQAPGKGLEWISAINWNGGSTYYAESMKGRFTISRDNAKNTLYLQMYSLQSDDTAVYYCVKDTVVSGNGYWGQGTQVTVSS

SEQ ID NO: 12552 - protein, 117 aa, Artificial Sequence
  Description of Artificial Sequence: Synthetic polypeptide
  Variable domain
QVQLVESGGGLVQPGGSLRLSCAASGFTFDDYAMSWVRQAPGKGLEWVSAISWNGSSTYYAESMKGRFTISRDNAKNTLYLQMNSLKSEDTAVYYCAKDLIGSHDYWGQGTQVTVSS

SEQ ID NO: 12553 - protein, 122 aa, Artificial Sequence
  Description of Artificial Sequence: Synthetic polypeptide
  Variable domain
EVQVQESGPGLVKPSQTLSLTCTVSGGSMTGNYYAWSWIRQPPGKGLEWMGVIAYDGSTYYSPSLKSRTSISRDTSKNQFSLQLSSVSPEDTAVYYCARGPGWYSGSRNDYWGQGTQVTVSS

SEQ ID NO: 12554 - protein, 119 aa, Artificial Sequence
  Description of Artificial Sequence: Synthetic polypeptide
  Variable domain
EVQLVQPGVELRNPGASVKVSCKASGYIFTMNSIDWVRQAPGQGLEWMGRIDPEDGGTKYAQKFQGRVTFTADTSTSTAYVELNSLRSEDTAVYYCARVDDYYLGYDYWGQGTQVTVSS

SEQ ID NO: 12555 - protein, 119 aa, Artificial Sequence
  Description of Artificial Sequence: Synthetic polypeptide
  Variable domain
EVQLVQPGAELRNPGASVKVSCKASGYTFTNYVIDWVRQAPGQGLEWMGRIDPENGGTRYAQKFQGRVTFTADTSTSTAYVELSNLRSEDTAVYYCARLEDYELAYDYWGQGTQVTVSS

SEQ ID NO: 12556 - protein, 127 aa, Artificial Sequence
  Description of Artificial Sequence: Synthetic polypeptide
  Variable domain
QVQLVESGPGLVKPSQTLSLTCAVSGGSITTNYYYWSWIRQSPGKGLEWMGVIAYDGSTDYSPSLKSRTSISRDTSKNQFSLQLSSVTPEDTAVYYCARDVRVIATGWATANALDAWGQGTLVTVSS

SEQ ID NO: 12557 - protein, 120 aa, Artificial Sequence
  Description of Artificial Sequence: Synthetic polypeptide
  Variable domain
ELQLVESGGALVQPGGSLRLSCVESGFTFSSYAMSWVRQAPGKGLEWVSGIYKGGGPKYANSVKGRFTISRDNAKNTLYLQMNSLKPEDTAVYYCAKSGYGSSLGDFGSWGQGTQVTVSS

SEQ ID NO: 12558 - protein, 127 aa, Artificial Sequence
  Description of Artificial Sequence: Synthetic polypeptide
  Variable domain
QVQLVESGPGLVKPSQTLSLTCAVSGGSITTNYYYWSWIRQSPGKGLEWMGVIAYDGSTDYSPSLKSRTSISRDTSKNQFSLQLSSVTPEDTAVYYCARDVRVIATGWATANALDAWGQGTQVTVSS

SEQ ID NO: 12559 - protein, 112 aa, Artificial Sequence
  Description of Artificial Sequence: Synthetic polypeptide
DVQLQESGPGLVKPSQSLSLTCTVTGFSITTEYAWNWIRQFPGNRLEWMGYIGYTGRTNYAPSLKSRISITRDTSKNQFFLQLNSVTTEDTATYYCTRMDYWGQGTSVTVSS

SEQ ID NO: 12560 - protein, 112 aa, Artificial Sequence
  Description of Artificial Sequence: Synthetic polypeptide
DVQLQESGPGLVKPSQSLSLTCTVTGFSITTEYAWNWIRQFPGNRLEWMGYIGYTGRTYYSPSLKSRISITRDTSKNQFFLQLNSVTTEDTATYYCTRMDYWGQGTSVTVSS

SEQ ID NO: 12561 - protein, 112 aa, Artificial Sequence
  Description of Artificial Sequence: Synthetic polypeptide
DVQLQESGPGLVKPSQSLSLTCTVTGFSITTEYAWNWIRQFPGNRLEWMGYIGYTGRTSYSPSLKSRISITRDTSKNQFFLQLNSVTTEDTATYYCTRMDYWGQGTSVTVSS

SEQ ID NO: 12562 - protein, 112 aa, Artificial Sequence
  Description of Artificial Sequence: Synthetic polypeptide
DVQLQESGPGLVKPSQSLSLTCTVTGFSITTEYAWNWIRQFPGNRLEWMGYIGYTGRTGYSPSLKSRISITRDTSKNQFFLQLNSVTTEDTATYYCTRMDYWGQGTSVTVSS

SEQ ID NO: 12563 - protein, 112 aa, Artificial Sequence
  Description of Artificial Sequence: Synthetic polypeptide
DVQLQESGPGLVKPSQSLSLTCTVTGFSITTEYAWNWIRQFPGNRLEWMGYIGYTGRTSYAPSLKSRISITRDTSKNQFFLQLNSVTTEDTATYYCTRMDYWGQGTSVTVSS

SEQ ID NO: 12564 - protein, 112 aa, Artificial Sequence
  Description of Artificial Sequence: Synthetic polypeptide
DVQLQESGPGLVKPSQSLSLTCTVTGFSITTEYAWNWIRQFPGNRLEWMGYIGYTGRTGYAPSLKSRISITRDTSKNQFFLQLNSVTTEDTATYYCTRMDYWGQGTSVTVSS

SEQ ID NO: 12565 - protein, 116 aa, Homo sapiens
EVQLVESGGGLVQPGGSLRLSCAASGFSFTGHWMNWVRQAPGKGLEWVGMIHPSDSETRYADSVKGRFTISRDNSKNTLYLQMNSLRAEDTAVYYCAARGIYFYGTTYFDYWGQGT

SEQ ID NO: 12566 - protein, 117 aa, Artificial Sequence
  Description of Artificial Sequence: Synthetic polypeptide
  Synthetic gamma heavy chain protein sequence
QVQLQESGPGLVKPSETLSLTCTVSGYSITGGYLWNWIRQPPGKGLEWMGYISYDGTNNYKPSLKDRITISRDTSKNQFSLKLSSVTAADTAVYYCARYGRVFFDYWGQGTLVTVSS

SEQ ID NO: 12567 - protein, 130 aa, Artificial Sequence; identical to SEQ ID NO: 12410
  Description of Artificial Sequence: Synthetic polypeptide

SEQ ID NO: 12568 - protein, 119 aa, Artificial Sequence
  Description of Artificial Sequence: Synthetic polypeptide
EVQLVQSGGGLVHPGGSLRLSCAGSGFTFRNYAMYWVRQAPGKGLEWVSAIGSGGGTYYADSVKGRFTISRDNAKNSLYLQMNSLRAEDMAVYYCARAPNWGSDAFDIWGQGTMVTVSS

SEQ ID NO: 12569 - protein, 117 aa, Artificial Sequence [sequence omitted]

SEQ ID NO: 12570 - protein, 117 aa, Artificial Sequence; identical to SEQ ID NO: 10732
  Description of Artificial Sequence: Synthetic polypeptide
  Synthetic gamma heavy chain protein sequence

SEQ ID NO: 12571 - protein, 174 aa, Artificial Sequence
  Description of Artificial Sequence: Synthetic polypeptide
  immunoglobulin heavy chain variable region
GRLGQAWRSLRLSCAASGFTFSDYYMSWIRQAPGKGLEWVSYISSSGSTRDYADSVKGRFTISRDNAKNSLYLQMNSLRAEDTAVYYCVRDGVETTFYYYYYGMDVWGQGTTVTVSSASTKGPSVFPLAPCSRSTSESTAALGCLVKDYFPEPVTVSWNSGALTSGVHTFPSCA

SEQ ID NO: 12572 - protein, 124 aa, Artificial Sequence
  Description of Artificial Sequence: Synthetic polypeptide
  immunoglobulin heavy chain variable region
VQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSS

SEQ ID NO: 12573 - protein, 112 aa, Artificial Sequence
  Description of Artificial Sequence: Synthetic polypeptide
  immunoglobulin heavy chain variable region
GPGLVKPSETLSLTCTVSGGSISNYYWSWIRQPAGKGLEWIGRIYTSGSPNYNPSLKSRVTMSVDTSKNQFSLKLNSVTAADTAVYYCAVTIFGVVIIFDYWGQGTLVTVSS

SEQ ID NO: 12574 - protein, 113 aa, Artificial Sequence
  Description of Artificial Sequence: Synthetic polypeptide
  immunoglobulin heavy chain variable region
PGLVKPSETLSLTCTVSGGSISSYYWSWIRQPPGKGLEWIGYIYYSGSTNYNPSLKSRVTISVDTSKNQFSLKLSSVTAADTAVYYCARTYSSSFYYYGMDVWGQGTTVTVSS

SEQ ID NO: 12575 - protein, 122 aa, Artificial Sequence; identical to SEQ ID NO: 10805
  Description of Artificial Sequence: Synthetic polypeptide
  immunoglobulin heavy chain variable region

SEQ ID NO: 12576 - protein, 473 aa, Artificial Sequence; identical to SEQ ID NO: 10993
  Description of Artificial Sequence: Synthetic polypeptide
  heavy chain immunoglobulin

SEQ ID NO: 12577 - protein, 470 aa, Artificial Sequence; identical to SEQ ID NO: 10994
  Description of Artificial Sequence: Synthetic polypeptide
  heavy chain immunoglobulin

SEQ ID NO: 12578 - protein, 470 aa, Artificial Sequence; identical to SEQ ID NO: 10995
  Description of Artificial Sequence: Synthetic polypeptide
  heavy chain immunoglobulin

SEQ ID NO: 12579 - protein, 470 aa, Artificial Sequence; identical to SEQ ID NO: 10996
  Description of Artificial Sequence: Synthetic polypeptide
  heavy chain immunoglobulin

SEQ ID NO: 12580 - protein, 470 aa, Artificial Sequence
  Description of Artificial Sequence: Synthetic polypeptide
  immunoglobulin heavy chain of 2.12.1 fx
MEFGLSWVFLVAIIKGVQCQVQLVESGGGLVKPGGSLRLSCAASGFTFSDYYMSWIRQAPGKGLEWVSYISSSGSTRDYADSVKGRFTISRDNAKNSLYLQMNSLRAEDTAVYYCARDGVETTFYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 12581 - protein, 125 aa, Artificial Sequence
  Description of Artificial Sequence: Synthetic polypeptide
  Synthetic gamma heavy chain protein sequence
QVQLVESGGGLVKPGGSLRLSCAASGFTFSDYYMSWIRQAPGKGLEWVSYISSSGSTRDYADSVKGRFTISRDNAKNSLYLQMNSLRAEDTAVYYCARDGVETTFYYYYYGMDVWGQGTTVTVSS

SEQ ID NO: 12582 - protein, 117 aa, Artificial Sequence
  Description of Artificial Sequence: Synthetic polypeptide
  Heavy chain immunoglobulin variable region
QVQFQQSGAELVKPGASVKLSCKASGYTFTSYLMHWIKQRPGRGLEWIGRIDPNNVVTKFNEKFKSKATLTVDKPSSTAYMELSSLTSEDSAVYYCARYAYCRPMDYWGQGTTVTVS

SEQ ID NO: 12583 - protein, 123 aa, Artificial Sequence; identical to SEQ ID NO: 12274
  Description of Artificial Sequence: Synthetic polypeptide
  Heavy chain immunoglobulin variable region

SEQ ID NO: 12584 - protein, 473 aa, Artificial Sequence; identical to SEQ ID NO: 10993
  Description of Artificial Sequence: Synthetic polypeptide
  anti-IGF1R immunoglobulin

SEQ ID NO: 12585 - protein, 470 aa, Artificial Sequence; identical to SEQ ID NO: 10994
  Description of Artificial Sequence: Synthetic polypeptide
  anti-IGF1R immunoglobulin

SEQ ID NO: 12586 - protein, 470 aa, Artificial Sequence; identical to SEQ ID NO: 10995
  Description of Artificial Sequence: Synthetic polypeptide
  anti-IGF1R immunoglobulin

SEQ ID NO: 12587 - protein, 470 aa, Artificial Sequence; identical to SEQ ID NO: 10996
  Description of Artificial Sequence: Synthetic polypeptide
  anti-IGF1R immunoglobulin

SEQ ID NO: 12588 - protein, 470 aa, Artificial Sequence; identical to SEQ ID NO: 12580
  Description of Artificial Sequence: Synthetic polypeptide
  anti-IGF1R immunoglobulin

SEQ ID NO: 12589 - protein, 135 aa, Homo sapiens
MKVLSLLYLLTAIPGILSQVQLQESGPGLVKPSETLSLTCTVSGYSISGGYLWNWIRQPPGKGLEWIGYISYDGTNNYKPSLKDRVTISVDTSKNQFSLKLSSVTAADTAVYYCARYGRVFFDYWGQGTLVTVSS

SEQ ID NO: 12590 - protein, 99 aa, Unknown
  Description of Unknown: rabbit polypeptide
HCQSLEESGGGLVKPGASLTLTCTASGFSFSNNDWMCWVRQAPGKGLEWICIYGGSSIGTNYAGWAKGRFTISRTSSTTVALQMTSLTVADTATYFCTR

SEQ ID NO: 12591 - protein, 97 aa, Unknown
  Description of Unknown: rabbit polypeptide
QCQSVEESGGRLVTPGTPLTLTCTVSGFSLNTYGVSWVRQAPGKGLEWIGYIFTDGQTYYASWAKGRFTISKTSSTTVDLKITSPTTEDTATYFCAS

SEQ ID NO: 12592 - protein, 468 aa, Homo sapiens
MDWTWRILFLVAAATGTHAQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12593 - protein, 457 aa, Artificial Sequence
  Description of Artificial Sequence: Synthetic polypeptide
  etuximab S119 K216 Heavy Chain with Flag Tag
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKDYKDDDDK

SEQ ID NO: 12594 - protein, 393 aa, Artificial Sequence
  Description of Artificial Sequence: Synthetic polypeptide
EVQLLESGGGLVQPGGSLRLSCAASGFTFSIYRMQWVRQAPGKGLEWVSGISPSGGTTWYADSVKGRFTISRDNSKNTLYLQMNSLRAEDTAVYYCARWSGGSGYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKGGGGSGGGGSGGGGSGGGGSNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEEVVVRVLDERLVRLRDGTRSYFGAFMV

SEQ ID NO: 12595 - protein, 214 aa, Artificial Sequence
  Description of Artificial Sequence: Synthetic polypeptide
DIQMTQSPLSLSASVGDRVTITCQASRDIRNYLNWYQQKPGKAPKLLIYDASSLQTGVPSRFGGSGSGTDFSFTIGSLQPEDIATYYCQQFDSLPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12596 - protein, 483 aa, Artificial Sequence
  Description of Artificial Sequence: Synthetic polypeptide
  Synthetic construct
MGWTWIFILILSVTTGVHSEVQLQQSGPELEKPGASVKISCKASGYSFTGYNMNWVKQSNGKSLEWIGNIDPYYGAASYNQKFKGKATLTVDKSSSTAYMQLKSLTSEDSAVYYCARSQLPYWYFDVWGAGTTVTVSSASTKGPSVFPLAPSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12597 - protein, 465 aa, Artificial Sequence
  Description of Artificial Sequence: Synthetic polypeptide
MRVLILLWLFTAFPGILSDVQLQESGPGLVKPSQSLSLTCTVTGYSITSDYAWNWIRLFPGNKLEWMGFINYSGNTSYNPSLKSRISITRDTSKNQFFLKLNSLTTDDTATYYCARGGLSRFPYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12598 - protein, 350 aa, Artificial Sequence
  Description of Artificial Sequence: Synthetic polypeptide
ISSSGGLTWYADSVKGRFTISRDNSKNTLYLQMNSLRAEDTAVYYCASPPGIAVARDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKLHWRLGEMVTRLPDGPAGSWQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEEVVVRVLDERLVRLRDGTRSYFGAFMV

SEQ ID NO: 12599 - protein, 405 aa, Artificial Sequence [sequence omitted]

SEQ ID NO: 12600 - protein, 392 aa, Artificial Sequence
  Description of Artificial Sequence: Synthetic polypeptide
EVQLLESGGGLVQPGGSLRLSCAASGFTFSSYGMVWVRQAPGKGLEWVSSISSSGGLTWYADSVKGRFTISRDNSKNTLYLQMNSLRAEDTAVYYCASPPGIAVARDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKGGGGSGGGGSGGGGSGGGGSNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEEVVVRVLDERLVRLRDGTRSYFGAFMV

SEQ ID NO: 12601 - protein, 396 aa, Artificial Sequence
  Description of Artificial Sequence: Synthetic polypeptide
EVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSGGGGSNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEEVVVRVLDERLVRLRDGTRSYFGAFMVGGHHHHHHHHHH

SEQ ID NO: 12602 - protein, 391 aa, Artificial Sequence
  Description of Artificial Sequence: Synthetic polypeptide
EVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKGGGGSGGGGSGGGGSGGGGSNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEEVVVRVLDERLVRLRDGTRSYFGAFMV

SEQ ID NO: 12603 - protein, 449 aa, Homo sapiens
EVQLLESGGGLVQPGGSLRLSCAASGFTFSSYGMVWVRQAPGKGLEWVSSISSSGGLTWYADSVKGRFTISRDNSKNTLYLQMNSLRAEDTAVYYCASPPGIAVARDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSAYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12604 - protein, 400 aa, Artificial Sequence [sequence omitted]

SEQ ID NO: 12605 - protein, 117 aa, Homo sapiens
  MOD_RES (59)..(59): Any amino acid
QVQLQESGPGLVKPSQTLSLTCTVSGGSVSSYWSWNWIRQPPGKGLEWIGRIYYSGSTXYNPSLKSRVTISVDTSKNQFSLKLSSVTAADTAVYYCARELPGGYDVWGQGTLVTVSS

SEQ ID NO: 12606 - protein, 473 aa, Artificial Sequence; identical to SEQ ID NO: 10993
  Description of Artificial Sequence: Synthetic polypeptide
  heavy chain immunoglobulin

SEQ ID NO: 12607 - protein, 470 aa, Artificial Sequence; identical to SEQ ID NO: 10994
  Description of Artificial Sequence: Synthetic polypeptide
  heavy chain immunoglobulin

SEQ ID NO: 12608 - protein, 470 aa, Artificial Sequence; identical to SEQ ID NO: 10995
  Description of Artificial Sequence: Synthetic polypeptide
  heavy chain immunoglobulin

SEQ ID NO: 12609 - protein, 470 aa, Artificial Sequence; identical to SEQ ID NO: 10996
  Description of Artificial Sequence: Synthetic polypeptide
  heavy chain immunoglobulin

SEQ ID NO: 12610 - protein, 330 aa, Homo sapiens [sequence omitted]

SEQ ID NO: 12611 - protein, 330 aa, Artificial Sequence
  Description of Artificial Sequence: Synthetic polypeptide
  human heavy chain constant region derived from IgG1 mutated on L234A and L235A
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12612 - protein, 327 aa, Homo sapiens; identical to SEQ ID NO: 5342

SEQ ID NO: 12613 - protein, 327 aa, Artificial Sequence; identical to SEQ ID NO: 5350
  Description of Artificial Sequence: Synthetic polypeptide
  human heavy chain constant region derived from IgG4 mutated  onS228P

SEQ ID NO: 12614 - protein, 109 aa, Artificial Sequence
  Description of Artificial Sequence: Synthetic polypeptide
DIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQGTKVEIKRT

SEQ ID NO: 12615 - protein, 107 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIK

SEQ ID NO: 12616 - protein, 214 aa, Artificial Sequence; identical to SEQ ID NO: 7630
  Description of Artificial Sequence: Synthetic polypeptide
  24-34 CDR1; 50-56 CDR2; 89-97 CDR3

SEQ ID NO: 12617 - protein, 108 aa, Homo sapiens
  2.9D10
EIVLTQSPGTLSLSPGERATLSCRASQSVSSNYLAWFQQKPGQAPRLLIFGTSSRATGIPDRFSGSGSGTDFTLTISRLEPEDFAVYYCQQYGSSIFTFGPGTKVDIK

SEQ ID NO: 12618 - protein, 108 aa, Homo sapiens
  2.14H9
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTEVEIK

SEQ ID NO: 12619 - protein, 108 aa, Homo sapiens
  3.18G1
SYVLTQPPSVSVAPGQTARITCGGNNIGSKSVHWYQQKPGQAPVLVVYDDSDRPSGIPERFSGSNSGNTATLTISRVEAGDEADYYCQVWDSSNDHVVFGGGTKLTVL

SEQ ID NO: 12620 - protein, 108 aa, Homo sapiens
  2.7A4_opti
SYELTQPPSVSVSPGQTARITCSGDALPQKYVFWYQQKSGQAPVLVIYEDSKRPSGIPERFSGSSSGTMATLTISGAQVEDEADYYCYSTDRSGNHRVFGGGTKLTVL

SEQ ID NO: 12621 - protein, 108 aa, Homo sapiens
  2.14H9_opti
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 12622 - protein, 215 aa, Artificial Sequence
  Description of Artificial Sequence: Synthetic polypeptide
EIVLTQSPALMAASPGEKVTITCSVSSSINSINLHWYRQKSETSPKPWIYGTSNLASGVPVRFSGSGSGTSYSLTISSMEAEDAATYYCQQWSSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 12623 - protein, 179 aa, Homo sapiens
QAIVTLNTQAMHPTRWELSHMVDLQAAALVISSFITEHRGLTMEFGLSWVFLVALLRGIQCQVQLVESGGGVVQPGRSLRLSCAASGFPFRSFAMHWVRQALGKGLEWVAVISYDGSTKYYADSVKGRFTISRDTSKNTVYLKMNRLRTEDTAVFYLCERQSLLGDYDHYYGLDAWGKG

SEQ ID NO: 12624 - protein, 108 aa, Artificial Sequence; identical to SEQ ID NO: 9271
  Description of Artificial Sequence: Synthetic polypeptide

SEQ ID NO: 12625 - protein, 219 aa, Artificial Sequence
  Description of Artificial Sequence: Synthetic polypeptide
  Light chain T427 (wt IgG)
MDIVLTQSPTSLAVSLGQRATISCRASESVDSYGNSFMHWFQQKPGQPPKLLIYRASNLESGIPARFSGSGSWTDFTLTINPVEADDVATYYCQQSNEDPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12626 - protein, 217 aa, Artificial Sequence
  Description of Artificial Sequence: Synthetic polypeptide
  Light chain T427 A104C:Cys218del (Cys)
MDIVLTQSPTSLAVSLGQRATISCRASESVDSYGNSFMHWFQQKPGQPPKLLIYRASNLESGIPARFSGSGSWTDFTLTINPVEADDVATYYCQQSNEDPRTFGCGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRG

SEQ ID NO: 12627 - protein, 220 aa, Artificial Sequence
  Description of Artificial Sequence: Synthetic polypeptide
  Synthetic amino acid sequence of H1-light
DIVMTQSPDSLAVSLGERATINCKSSQSLLASGNQNNYLAWHQQKPGQPPKMLIIWASTRVSGVPDRFSGSGSGTDFTLTISSLQAEDVAVYYCQQSYSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12628 - protein, 220 aa, Artificial Sequence
  Description of Artificial Sequence: Synthetic polypeptide
  Synthetic amino acid sequence of H3-light
DIVMTQSPDSLAVSLGERATINCKSSQSLLASGNQNNYLAWYQQKPGQPPKLLIIWASTRVSGVPDRFSGSGSGTDFTLTISSLQAEDVAVYYCQQSYSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12629 - protein, 219 aa, Artificial Sequence
  Description of Artificial Sequence: Synthetic polypeptide
  Synthetic amino acid sequence of H4-light
DIQMTQSPSSLSASVGDRVTITCKSSQSLLASGNQNNYLAWHQQKPGKAPKMLIIWASTRVSGVPSRFSGSGSGTDFTLTISSLQPEDFATYYCQQSYSAPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 12630 - protein, 220 aa, Artificial Sequence
  Description of Artificial Sequence: Synthetic polypeptide
  Synthetic amino acid sequence of light chain of antibody L3-11Y
DIQMTQSPSSLSASVGDRVTITCKSSQSLLAWGNQNNYLAWYQQKPGKAPKMLIIWASTRVSGVPSRFSGSGSGTDFTLTISSLQPEDFATYYCQQSYSRPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12631 - protein, 111 aa, Mus musculus
DIVLTQSPASLAVSLGQRATISCRASESVDSYANSFMHWYQQKPGQPPKLLIYRASNLESGIPARFSGSGSRTDFTLTINPVEADDVATYYCQQSKEDPLTFGSGTKLEMK

SEQ ID NO: 12632 - protein, 111 aa, Mus musculus
GIVLTQSPASLAVSLGQRATISCRVSESIDTYGNSFIHWYQQKPGQPPKLLIYRASNLESGIPARFSGSGSRTDFTLTINPVEADDSATYYCQQSNEDPFTFGSGTKLEMK

SEQ ID NO: 12633 - protein, 107 aa, Mus musculus
DIQMTQSPASLSVSVGETVTITCRASENIYSNLAWYQQKQGKSPQLLVYAATNLVDGVPSRFSGSGSGTQYSLKINSLQSEDFGSYYCQHFWGPPYTFGGGTKLEIK

SEQ ID NO: 12634 - protein, 108 aa, Mus musculus
QIVLTQSPAIMSASPGEKVTLTCSASSSVSSTYLYWYQQKPGSSPKLWIYTTSILASGVPARFSGSGSGTSYSLTISSMETEDAASYFCHQWSSYPFTFGSGTKLDIK

SEQ ID NO: 12635 - protein, 445 aa, Mus musculus
QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSSASTKGPSVFPLAPSSKSTSGGTAALGCLVKDFPEPVTVSWNSGALTSGVHTFPAVLQSSGLYSLSSVVTVPSSSLGTQTYICNVNHKPSNTKVDKRVEPKSCDCHCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12636 - protein, 218 aa, Mus musculus
DIVMTQSPDSLAVSLGERATINCKSSESVDSYANSFMHWYQQKPGQPPKLLIYRASTRESGVPDRFSGSGSGTDFTLTISSLQAEDVAVYYCQQSKEDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12637 - protein, 218 aa, Mus musculus
DIVMTQSPDSLAVSLGERATINCKSSESVDSYANSFLHWYQQKPGQPPKLLIYRASTRESGVPDRFSGSGSGTDFTLTISSLQAEDVAVYYCQQSKEDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12638 - protein, 218 aa, Mus musculus
DIVLTQSPASLAVSLGQRATISCRASESVDSYANSFMHWYQQKPGQPPKLLIYRASNLESGIPARFSGSGSRTDFTLTINPVEADDVATYYCQQSKEDPLTFGSGTKLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12639 - protein, 130 aa, Homo sapiens
QVQLKESGGGLVQPGGSLTLSCATSGFTFTDHYMSWVRQPPGKALEWLAFIRNKAKGYTTEYNASVRGRFTISRDNSQNIVYLQMNTLRTEDSATYYCARDGVGIAYWGQTLVTVSAAKTTPPSVYPLAP

SEQ ID NO: 12640 - protein, 442 aa, Artificial Sequence; identical to SEQ ID NO: 10460
  Description of Artificial Sequence: Synthetic polypeptide
  Synthetic Light chain of anti-c-Met antibody LY2875358

SEQ ID NO: 12641 - protein, 215 aa, Artificial Sequence
  Description of Artificial Sequence: Synthetic polypeptide
  synthetic construct
EIVLTQSPGTLSLSPGERATLSCSVSSSISSTNLHWYQQKPGQAPRLLIYGTSYLASGIPDRFSGSGSGTDFTLTISRLEPEDFAVYYCQQWSSYPYSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12642 - protein, 215 aa, Artificial Sequence
  Description of Artificial Sequence: Synthetic polypeptide
  synthetic construct
EIVLTQSPGTLSLSPGERATLSCSVSSSISSTNLHWYQQKPGQAPRLLIYGTSRLRSGIPDRFSGSGSGTDFTLTISRLEPEDFAVYYCQQWSSYPYSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12643 - protein, 215 aa, Artificial Sequence
  Description of Artificial Sequence: Synthetic polypeptide
  synthetic construct
DIQMTQSPSSLSASVGDRVTITCSVSSSVSSIYLHWYQQKPGKAPKLLIYSTSNLASGVPSRFSGSGSGTDFTLTISSLQPEDFATYYCIQYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12644 - protein, 215 aa, Artificial Sequence; identical to SEQ ID NO: 7839
  Description of Artificial Sequence: Synthetic polypeptide
  synthetic construct

SEQ ID NO: 12645 - protein, 215 aa, Artificial Sequence
  Description of Artificial Sequence: Synthetic polypeptide
  synthetic construct
DIQMTQSPSSLSASVGDRVTITCSVSSSVRSIYLHWYQQKPGKAPKLLIYSTSNLASGVPSRFSGSGSGTDFTLTISSLQPEDFATYYCQVYRGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12646 - protein, 220 aa, Artificial Sequence
  Description of Artificial Sequence: Synthetic polypeptide
  Synthetic amino acid sequence of H2-light
DIVMTQTPLSLPVTPGEPASISCKSSQSLLASGNQNNYLAWHLQKPGQSPQMLIIWASTRVSGVPDRFSGSGSGTDFTLKISRVEAEDVGVYYCQQSYSAPLTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12647 - protein, 112 aa, Mus musculus
DIVMSQSPSSLAVSAGEKVTMSCKSSQSLYNSRTRKNYLAWYQQKPGQSPKLLIYWASTRESGVPDRFTGSGSGTDFTLTITSVQAEDLAVFYCKQSYNLRTFGGGTKLEIK

SEQ ID NO: 12648 - protein, 112 aa, Mus musculus
DIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIK

SEQ ID NO: 12649 - protein, 105 aa, Mus musculus [sequence omitted]

SEQ ID NO: 12650 - protein, 239 aa, Mus musculus
MESQTLVFISILLWLYGTCGDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12651 - protein, 108 aa, Artificial Sequence
  Description of Artificial Sequence: Synthetic polypeptide
DIQMTQSPSSLSASLGGKVTITCKASQDINNYIAWYQHKPGKGPRLLIHYTSTLHPGIPSRFSGSGSGRDYSFSISNLEPEDIATYYCLQYDNLLYTFGGGTKLEIKR

SEQ ID NO: 12652 - protein, 128 aa, Mus musculus
MVSTAQFLAFLLLWFPGARCDILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKR

SEQ ID NO: 12653 - protein, 108 aa, Mus musculus
DILMTQSPSSMSLSLGDTVSITCHSSQDINSNIGWLQQKPGKSFKGLIYHGTNLDDGVPSRFSGSGSGADYSLTISSLESEDFVDYYCVQYGQFPWTFGGGTKLEIKR

SEQ ID NO: 12654 - protein, 108 aa, Mus musculus
DILMTQSPSSMSVSLGDTVNITCHSSQDINSNIGWLQQKPGKSFKGLIYHGTNLDDGVPSRFSGSGSGADYSLTISSLESEDFADYYCVQYGQFPWTFGGGTKLEIKR

SEQ ID NO: 12655 - protein, 209 aa, Artificial Sequence
  Description of Artificial Sequence: Synthetic polypeptide
  Synthetic construct
MDWTWRILFLVAAATGVHSDIQMTQSPSSMSVSVGDRVTITCHSSQDINSNIGWLQQKPGKSFKGLIYHGTNLDDGVPSRFSGSGSGTDYTLTISSLEPEDFATYYCVQHAQFPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHK

SEQ ID NO: 12656 - protein, 233 aa, Artificial Sequence
  Description of Artificial Sequence: Synthetic polypeptide
  Synthetic construct
MDWTWRILFLVAAATGVHSDIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12657 - protein, 214 aa, Artificial Sequence
  Description of Artificial Sequence: Synthetic polypeptide
  EU IgG1 light chain
DIQMTQSPSTLSASVGDRVTITCRASQSINTWLAWYQQKPGKAPKLLMYKASSLESGVPSRFIGSGSGTEFTLTISSLQPDDFATYYCQQYNSDSKMFGQGTKVEVKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12658 - protein, 213 aa, Homo sapiens
  MOD_RES (53)..(53): Glu or an amino acid having a side chain that is either nonpolar and/or is neutral or positive in charge and/or may not be small
  MOD_RES (94)..(94): Trp or an amino acid having a side chain that is either polar and/or is charge positive or negative and/or is not bulky
DILLTQSPVILSVSPGERVSFSCRASQSIGTNIHWYQQRTNGSPRLLIKYASXSISGIPSRFSGSGSGTDFTLSINSVESEDIADYYCQQNNNXPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 12659 - protein, 234 aa, Homo sapiens
MVLQTQVFISLLLWISGAYGDILLTQSPVILSVSPGERVSFSCRASQSIGTNIHWYQQRTNGSPRLLIKYASKSISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12660 - protein, 234 aa, Homo sapiens
MVLQTQVFISLLLWISGAYGDILLTQSPVILSVSPGERVSFSCRASQSIGTNIHWYQQRTNGSPRLLIKYASESISGIPSRFSGSGSGTDFTLSINSVESEDIADYYCQQNNNAPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12661 - protein, 128 aa, Artificial Sequence
  Description of Artificial Sequence: Synthetic polypeptide
MGTPAQLLFLLLLWLPDTTGEIVMTQSPATLSVSPGERATLSCRASQSVSSNLAWYQQKPGQAPRLLIYGASTRATGIPARFSGSGSGTEFTLTISSLQSEDFAVYYCQDYRSWPRRAFGGGTKVEIK

SEQ ID NO: 12662 - protein, 128 aa, Artificial Sequence
  Description of Artificial Sequence: Synthetic polypeptide
MGTPAQLLFLLLLWLPDTTGEIVMTQSPATLSVSPGERATLSCRASQSVSSNLAWYQQKPGQAPRLLIYGASTRATGIPARFSGSGSGTEFTLTISSLQSEDFAVYYCQDYRTWPRRAFGGGTKVEIK

SEQ ID NO: 12663 - protein, 128 aa, Artificial Sequence
  Description of Artificial Sequence: Synthetic polypeptide
MGTPAQLLFLLLLWLPDTTGEIVMTQSPATLSVSPGERATLSCRASQSVSSNLAWYQQKPGQAPRLLIYGASTRATGIPARFSGSGSGTEFTLTISSLQSEDFAVYYCQQYNDWPRWTFGGGTKVEIK

SEQ ID NO: 12664 - protein, 127 aa, Artificial Sequence
  Description of Artificial Sequence: Synthetic polypeptide
MGTPAQLLFLLLLWLPDTTGEIVLTQSPATLSLSPGERATLSCRASQSVSSYLAWYQQKPGAPRLLIYDASNRATGIPARFSGSGSGTDFTLTISSLEPEDFAVYYCQQRGSWPRITFGGGTKVEIK

SEQ ID NO: 12665 - protein, 127 aa, Artificial Sequence
  Description of Artificial Sequence: Synthetic polypeptide
MGTPAQLLFLLLLWLPDTTGEIVLTQSPATLSLSPGERATLSCRASQSVSSYLAWYQQKPGAPRLLIYDASNRATGIPARFSGSGSGTDFTLTISSLEPEDFAVYYCHQRGTWPSMTFGGGTKVEIK

SEQ ID NO: 12666 - protein, 133 aa, Artificial Sequence
  Description of Artificial Sequence: Synthetic polypeptide
MGTPAQLLFLLLLWLPDTTGDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYGSPITFGGGTKVEIK

SEQ ID NO: 12667 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12668 - protein, 132 aa, Artificial Sequence
  Description of Artificial Sequence: Synthetic polypeptide
MGTPAQLLFLLLLWLPDTTGDIVMTQSPDSLAVSLGERATINCKSSQSVLYSSNNKNYLAWYQQKPGQPPKLLISWASTRESGVPDRFSGSGSGTDFTLTISSLQAEDVAVYYCGQFYGSITFGGGTKVEIK

SEQ ID NO: 12669 - protein, 127 aa, Artificial Sequence
  Description of Artificial Sequence: Synthetic polypeptide
MGTPAQLLFLLLLWLPDTTGDIQMTQSPSTLSASVGDRVTITCRASQSISSWLAWYQQKPGKAPKLLIYDASSLESGVPSRFSGSGSGTEFTLTISSLQPDDFATYYCQQFAAHATTFGGGTKVEIK

SEQ ID NO: 12670 - protein, 127 aa, Artificial Sequence
  Description of Artificial Sequence: Synthetic polypeptide
MGTPAQLLFLLLLWLPDTTGDIQMTQSPSSLSASVGDRVTITCQASQDITNYLNWYQQKPGKAPKLLIYDASNLETGVPSRFSGSGSGTDFTFTISSLQPEDIATYYCHQYNAFPITFGGGTKVEIK

SEQ ID NO: 12671 - protein, 127 aa, Artificial Sequence
  Description of Artificial Sequence: Synthetic polypeptide
MGTPAQLLFLLLLWLPDTTGDIQMTQSPSTLSASVGDRVTITCRASQSISSWLAWYQQKPGKAPKLLIYDASSLESGVPSRFSGSGSGTEFTLTISSLQPDDFATYYCQQYIEYATTFGGGTKVEIK

SEQ ID NO: 12672 - protein, 106 aa, Artificial Sequence
  Description of Artificial Sequence: Synthetic polypeptide
MTQSPSSLSASLGERVSLTCQASQGISNNLNWYQQTPGKAPRLLIYDASKLEDGVPSRFSGTGYRTDFNFTISSLEEEDVATYFCLQHRYLPVHVRRGDQVGNKTG

SEQ ID NO: 12673 - protein, 213 aa, Artificial Sequence; identical to SEQ ID NO: 7956
  Description of Artificial Sequence: Synthetic polypeptide
  Cetuximab A100 LELK104-107 A213 light chain

SEQ ID NO: 12674 - protein, 214 aa, Artificial Sequence
  Description of Artificial Sequence: Synthetic polypeptide
  Cetuximab Q100 VEIK104-107 EC213-214 light chain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12675 - protein, 213 aa, Artificial Sequence
  Description of Artificial Sequence: Synthetic polypeptide
  Cetuximab Q100 LELK104-107 A213 light chain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 12676 - protein, 214 aa, Artificial Sequence; identical to SEQ ID NO: 7572
  Description of Artificial Sequence: Synthetic polypeptide
  Cetuximab A100 LELK104-107 EC213-214 light chain

SEQ ID NO: 12677 - protein, 214 aa, Artificial Sequence
  Description of Artificial Sequence: Synthetic polypeptide
  LC-I29S light chain amino acid Q100 VEIK104-107 EC213-214
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12678 - protein, 214 aa, Artificial Sequence
  Description of Artificial Sequence: Synthetic polypeptide
  EP-h1, 3 light chain amino acid Q100 VEIK
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12679 - protein, 214 aa, Artificial Sequence
  Description of Artificial Sequence: Synthetic polypeptide
  EP-h2 light chain amino acid Q100 VEIK
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12680 - protein, 214 aa, Artificial Sequence
  Description of Artificial Sequence: Synthetic polypeptide
  EP-h4 light chain amino acid Q100 VEIK
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12681 - protein, 214 aa, Artificial Sequence
  Description of Artificial Sequence: Synthetic polypeptide
  EP-h5 light chain amino acid Q100 VEIK
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12682 - protein, 214 aa, Artificial Sequence
  Description of Artificial Sequence: Synthetic polypeptide
  EP-h8 light chain amino acid Q100 VEIK
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12683 - protein, 214 aa, Artificial Sequence
  Description of Artificial Sequence: Synthetic polypeptide
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12684 - protein, 107 aa, Artificial Sequence
  Description of Artificial Sequence: Synthetic polypeptide
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGAGTKLELK

SEQ ID NO: 12685 - protein, 107 aa, Artificial Sequence
  Description of Artificial Sequence: Synthetic polypeptide
EIVLTQSPATLSLSPGERATLSCRASQSIGTNIHWYQQKPGKAPKLLIYYASESISGIPDRFSGSGSGTDFTLTISRLEPEDFAVYYCQQNNNWPTTFGAGTKLELK

SEQ ID NO: 12686 - protein, 107 aa, Artificial Sequence
  Description of Artificial Sequence: Synthetic polypeptide
  FEP-h6, 7, 8 light chain amino acid Q100 VEIK
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGAGTKLELK

SEQ ID NO: 12687 - protein, 107 aa, Artificial Sequence
  Description of Artificial Sequence: Synthetic polypeptide
  FEP-h9, 10, 11, 12, 20  light chain amino acid Q100 VEIK
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGAGTKLELK

SEQ ID NO: 12688 - protein, 107 aa, Artificial Sequence
  Description of Artificial Sequence: Synthetic polypeptide
  FEP-h13, 14, 15, 16, 21 light chain amino acid Q100 VEIK
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGAGTKLELK

SEQ ID NO: 12689 - protein, 107 aa, Artificial Sequence
  Description of Artificial Sequence: Synthetic polypeptide
  FEP-h17 light chain amino acid Q100 VEIK
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGAGTKLELK

SEQ ID NO: 12690 - protein, 260 aa, Artificial Sequence
  Description of Artificial Sequence: Synthetic polypeptide
  Des-1-3954-1204-C225 Activatable Antibody Light Chain
GQSGQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12691 - protein, 259 aa, Artificial Sequence
  Description of Artificial Sequence: Synthetic polypeptide
  Des-2-3954-1204-C225 Activatable Antibody Light Chain
QSGQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12692 - protein, 258 aa, Artificial Sequence
  Description of Artificial Sequence: Synthetic polypeptide
  Des-3-3954-1204-C225 Activatable Antibody Light Chain
SGQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12693 - protein, 257 aa, Artificial Sequence
  Description of Artificial Sequence: Synthetic polypeptide
  Des-4-3954-1204-C225 Activatable Antibody Light Chain
GQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12694 - protein, 256 aa, Artificial Sequence
  Description of Artificial Sequence: Synthetic polypeptide
  Des-5-3954-1204-C225 Activatable Antibody Light Chain
QCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12695 - protein, 109 aa, Mus sp.
SYELTQPPSVSVAPGQTARITCSGDALGDKYASWYQQKPGQAPVLVIYEDSKRPSGIPERFSGSNSGNTATLTISGTQAEDEADYYCSVWDGDWGMPVFGGGTKLTVLG

SEQ ID NO: 12696 - protein, 234 aa, Artificial Sequence
  Description of Artificial Sequence: Synthetic polypeptide
MMSSAQFLGLLLLCFQGTRCDIQMTQTTSSLSASLGDRVTISCRSSQDIRNYLNWYQQKPDGTVKLLIYYTSRSHSGVPSRFSGSGSGTDYSLTISNLEQEDIATYFCQQGNMFPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 12697 - protein, 214 aa, Artificial Sequence
  Description of Artificial Sequence: Synthetic polypeptide
ELVMTQSPSSLSASVGDRVNIACRASQSIGTNIHWYQQKPGKAPRLLIKYASESISGVPSRFSGSGSGTDFTLTISSLQPEDFAIYYCQQNNNWPTTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12698 - protein, 108 aa, Artificial Sequence
  Description of Artificial Sequence: Synthetic polypeptide
  muEGFR17LC
DIQMTQSPSSLSASLGGKVTITCKASQDINNYIAWYQHKPEKGPRLLIHYTSTLHPGIPSRFSGSGSGRDYSFSISNLEPEDIATYYCLQYDNLLYTFGGGTKLEIKR

SEQ ID NO: 12699 - protein, 119 aa, Artificial Sequence
  Description of Artificial Sequence: Synthetic polypeptide
  muEGFR2HC
QVQLQQSGAELARPGASVKLSCKASGYTFTSYWMQWVKQRPGQGLECIGAIYPGDGDTSYTQKFKGKATLTADKSSSTAYMQLSSLASEDSAVYYCARYDAPGYAMDYWGQGTSVTVSS

SEQ ID NO: 12700 - protein, 107 aa, Artificial Sequence
  Description of Artificial Sequence: Synthetic polypeptide
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKLELK

SEQ ID NO: 12701 - protein, 107 aa, Artificial Sequence
  Description of Artificial Sequence: Synthetic polypeptide
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGQGTKLELK

SEQ ID NO: 12702 - protein, 111 aa, Artificial Sequence
  Description of Artificial Sequence: Synthetic polypeptide
  synthetic antibody VL sequence
QSVLTQPPSVSAAPGQKVTISCSGSSSNIGNNYVSWYQQLPGTAPKLLIYGHTNRPAGVPDRFSGSKSGTSASLAISGFRSEDEADYYCASWDYTLSGWVFGGGTKLTVLG

SEQ ID NO: 12703 - protein, 111 aa, Artificial Sequence
  Description of Artificial Sequence: Synthetic polypeptide
  synthetic antibody VL sequence
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 12704 - protein, 111 aa, Artificial Sequence
  Description of Artificial Sequence: Synthetic polypeptide
  synthetic antibody VL sequence
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKVTVLG

SEQ ID NO: 12705 - protein, 165 aa, Homo sapiens
DIVMTQTPLSSPVTLGQPASISCRSSQSLVHSDGNTYLSWLHQRPGQPPRLLIYKISNRFSGVPDRFSGSGAGTAFTLKISRVEAEDVGVYYCMQATQLPRTFGQGTKVEIKRTVAAPSVFIFPPSDEQLKSGTASVVCLLNNFYPREAKVQWKVDNALQSGNSQ

SEQ ID NO: 12706 - protein, 112 aa, Homo sapiens
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 12707 - protein, 112 aa, Homo sapiens
AIVLTQTPLSSPVTLGQPASISCRSSQSLVHRDGNTYLSWLQQRPGQPPRLLIYKISNRFSGVPDRFSGSGAGTDFTLKISRVEPDDVGVYYCMHTTQLPWTFGQGTKVEIK

SEQ ID NO: 12708 - protein, 112 aa, Homo sapiens
DIVMTQTPLSSPVTLGQPASISCRSSQSLVHRDGNTYLSWLQQRPGQPPRLLIYKISNRFSGVPDRFSGSGAGTDFTLKISRVEAEDVGIYFCMHTTQFPWTFGQGTRVEIK

SEQ ID NO: 12709 - protein, 112 aa, Homo sapiens
DIVMTQSPLSLPVTPGEPASISCRSSQSLLYRNGNNYLDWYLQKPGQSPQLLIYLGSNRASGVPDRFSGSGSGTDFTLNISRVEAEDVGHYYCMQALQTPRTFGQGTKVEIK

SEQ ID NO: 12710 - protein, 112 aa, Homo sapiens
DIVMTQTPLSSPVTLGQPASISCRSSQSLIHTDGNIYLSWLQQRPGQPPRLLIYKISNRFSGVPDRFSGSGAGTDFTLKISRVEAEDVGVYYCMQGTQFPITFGQGTRLEIK

SEQ ID NO: 12711 - protein, 107 aa, Homo sapiens
DIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEIK

SEQ ID NO: 12712 - protein, 107 aa, Homo sapiens
DIQMTQSPSSLSASVGDSVTITCRTSQGIRKNLGWYQQKPGKAPKRLIYAASSLQSGVPSRFSGSGSGTEFTLTISRLQPEDFATYYCLQHHSYPLTFGGGTRVEIR

SEQ ID NO: 12713 - protein, 112 aa, Homo sapiens
DIVMTQSPLSLPVTPGEPASISCRSSQSLLYRNGNNYLDWYLQRPGQSPQLLIYLGSNRASGVPDRFSGSGSGTDFTLKISRVEAEDVGVYYCMQALQTPRTFGQGTKVEIK

SEQ ID NO: 12714 - protein, 113 aa, Homo sapiens
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPRTFGQGTKVEIKR

SEQ ID NO: 12715 - protein, 113 aa, Homo sapiens
DIVMTQTPLSSPVTLGQPASISCRSSQSLVHSDGNTYLSWLHQRPGQPPRLLIYKISNRFSGVPDRFSGSGAGTAFTLKISRVEAEDVGVYYCMQATQLPRTFGQGTKVEIKR

SEQ ID NO: 12716 - protein, 124 aa, Artificial Sequence
  Description of Artificial Sequence: Synthetic polypeptide
  KS49 light chain
DIQMTQSPSSLSASVGDRVTITCQASQDISNYLNWYQQKPGKAPKLLIYAASSLQSGVPSRFSGSGSGTDFTLTISSLQPEDFATYYCLQDYNGWTFGQGTKVDIKRAAAEQKLISEEDLNGAA

SEQ ID NO: 12717 - protein, 125 aa, Artificial Sequence
  Description of Artificial Sequence: Synthetic polypeptide
  KS83 light chain
DIVMTQSPSTVSASVGDRVIIPCRASQSIGKWLAWYQQKPGKAPKLLIYKASSLEGWVPSRFSGSGSGTEFSLTISSLQPDDSATYVCQQSHNFPPTFGGGTKLEIKRAAAEQKLISEEDLNGAA

SEQ ID NO: 12718 - protein, 124 aa, Artificial Sequence
  Description of Artificial Sequence: Synthetic polypeptide
  KS89 light chain; KS41 light chain
DIVMTQSPSSLSASVGDRVTITCRASQGIRNDLGWYQQKPGKAPELLIYGASSLQSGVPSRFSGSGSGTDFTLTISSLQPEDSATYYCLQDYNGWTFGQGTKLEIKRAAAEQKLISEEDLNGAA

SEQ ID NO: 12719 - protein, 214 aa, Artificial Sequence
  Description of Artificial Sequence: Synthetic polypeptide
  synthetic anti-EphA3 antibody light chain
DIQMTQSPSFLSASVGDRVTITCRASQGIISYLAWYQQKPEKAPKRLIYAASSLQSGVPSRFSGSGSGTEFTLTISSLQPEDFATYYCVQYANYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12720 - protein, 214 aa, Artificial Sequence
  Description of Artificial Sequence: Synthetic polypeptide
  synthetic anti-EphA3 antibody light chain
DIQMTQSPSFLSASVGDRVTITCRASQGIISYLAWYQQKPEKAPKRLIYAASSLQSGVPSRFSGSGSGTEFTLTISSLQPEDFATYYCVQYAKYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12721 - protein, 214 aa, Artificial Sequence; identical to SEQ ID NO: 7651
  Description of Artificial Sequence: Synthetic polypeptide
  synthetic anti-EphA3 antibody light chain

SEQ ID NO: 12722 - protein, 214 aa, Artificial Sequence
  Description of Artificial Sequence: Synthetic polypeptide
  synthetic anti-EphA3 antibody light chain
DIQMTQSPSFLSASVGDRVTITCRASQGIISYLAWYQQKPEKAPKRLIYAASSLQSGVPSRFSGSGSGTEFTLTISSLQPEDFATYYCAQYANYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12723 - protein, 214 aa, Artificial Sequence
  Description of Artificial Sequence: Synthetic polypeptide
  synthetic anti-EphA3 antibody light chain
DIQLTQSPSFLSASVGDRVTITCRASQGIISYLAWYQQKPEKAPKRLIYGASSLQSGVPSRFSGSGSGTEFTLTISSLQPEDFATYYCVQYANYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12724 - protein, 107 aa, Homo sapiens
DIQMTQSPSSLSASVGDRVTITCRASQGISNYLAWFQQKPGKAPKSLIYAASSLQSGVPSRFSGSGSGTDFTLTISSLQPEDFATYYCQQYNSYPITFGQGTRLEIK

SEQ ID NO: 12725 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPFTFGPGTKVDIK

SEQ ID NO: 12726 - protein, 112 aa, Homo sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPRTFGQGTKVEIK

SEQ ID NO: 12727 - protein, 112 aa, Homo sapiens
  MOD_RES (100)..(101): Any naturally occurring amino acid
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWXXTFGGGTKVEIK

SEQ ID NO: 12728 - protein, 214 aa, Artificial Sequence
  Description of Artificial Sequence: Synthetic polypeptide
  Light Chain
  MOD_RES (30)..(30): Asn or an amino acid having a side chain that is either nonpolar and/or is negative or positive in charge and/or may not be small
  MOD_RES (53)..(53): Phe or an amino acid having a side chain that is either polar and/or is charge positive or negative and/or is not large
  MOD_RES (92)..(92): Tyr or an amino acid having a side chain that is nonpolar and/or a side chain that is non-neutral and/or is not large
DIQMTQSPSSLSASVGDRVTITCRASQDVXTAVAWYQQKPGKAPKLLIYSASXLYSGVPSRFSGSRSGTDFTLTISSLQPEDFATYYCQQHXTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12729 - protein, 234 aa, Artificial Sequence
  Description of Artificial Sequence: Synthetic polypeptide
  Anti-HER2 light chain
MVLQTQVFISLLLWISGAYGDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12730 - protein, 234 aa, Artificial Sequence
  Description of Artificial Sequence: Synthetic polypeptide
  Light chain F53N
MVLQTQVFISLLLWISGAYGDIQMTQSPSSLSASVGDRVTITCRASQDVNTAVAWYQQKPGKAPKLLIYSASNLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12731 - protein, 234 aa, Artificial Sequence
  Description of Artificial Sequence: Synthetic polypeptide
  Light chain Y92A
MVLQTQVFISLLLWISGAYGDIQMTQSPSSLSASVGDRVTITCRASQDVNTAVAWYQQKPGKAPKLLIYSASFLYSGVPSRFSGSRSGTDFTLTISSLQPEDFATYYCQQHATTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12732 - protein, 234 aa, Artificial Sequence
  Description of Artificial Sequence: Synthetic polypeptide
  Light chain, F53N, Y92A
MVLQTQVFISLLLWISGAYGDIQMTQSPSSLSASVGDRVTITCRASQDVNTAVAWYQQKPGKAPKLLIYSASNLYSGVPSRFSGSRSGTDFTLTISSLQPEDFATYYCQQHATTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12733 - protein, 234 aa, Artificial Sequence
  Description of Artificial Sequence: Synthetic polypeptide
  Light chain FN30D
MVLQTQVFISLLLWISGAYGDIQMTQSPSSLSASVGDRVTITCRASQDVDTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12734 - protein, 215 aa, Artificial Sequence
  Description of Artificial Sequence: Synthetic polypeptide
  Light chain FRP5 (wt IgG)
MDIQLTQSHKFLSTSVGDRVSITCKASQDVYNAVAWYQQKPGQSPKLLIYSASSRYTGVPSRFTGSGSGPDFTFTISSVQAEDLAVYFCQQHFRTPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12735 - protein, 131 aa, Mus musculus
MKLPVRLLVLMFWIPASRSDVLMTQTPLSLPVSLGDQASISCRSSQSLVHSNGRTYLEWYLQKPGQSPKVLIYKVSNRISGVPDRFSGSGSGTDFTLKISRVEAEDLGVYFCFQGSHVPYTFGGGTKLEIK

SEQ ID NO: 12736 - protein, 261 aa, Artificial Sequence
  Description of Artificial Sequence: Synthetic polypeptide
  Control anti-EGFR activatable antibody
QGQSGQCISPRGCPDGPYVMYGSSGGSGGSGGSGLSGRSDNHGSSGTQILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12737 - protein, 234 aa, Artificial Sequence
  Description of Artificial Sequence: Synthetic polypeptide
MVLQTQVFISLLLWISGAYGDIQMTQSPSSLSAFLGDRVTITCRASQDIGNYLRWFQQKPGKSPRLMIYGATNLANGVPSRFSGSRSGSDYSLTINNLESEDMAIYYCLKHNEYPFTFGSGTKLEIKRAVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12738 - protein, 235 aa, Artificial Sequence
  Description of Artificial Sequence: Synthetic polypeptide
MVLQTQVFISLLLWISGAYGDIQMTQSPASLSASLGETVTIECRASEDIYSNLAWYQQKPGNSPQLLIYDANILADGVPSRFSGSGSGTQYSLKINSLQSEDVASYFCQQYNNYPPFTFGVGTKLELKRAVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12739 - protein, 235 aa, Artificial Sequence
  Description of Artificial Sequence: Synthetic polypeptide
MVLQTQVFISLLLWISGAYGDIQMTQSPASLSASLGETVTIECRASEDIYSNLAWYQQKPGNSPQLLIYDANILADGVPSRFSGSGSGTQYSLKINSLQSEDVASYFCQQYNNYPPFTFGAGTKLELKRAVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12740 - protein, 235 aa, Artificial Sequence
  Description of Artificial Sequence: Synthetic polypeptide
MVLQTQVFISLLLWISGAYGDIQMTQSPSSLSASVGDRVTITCRASEDIYSNLAWYQQKPGKSPQLLIYDANILADGVPSRFSGSGSGTDYTLTISSLQPEDFATYYCQQYNNYPPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12741 - protein, 214 aa, Homo sapiens
DIQMTQSPSSLSASVGDRVTITCRASQSISTYLNWYQQKPGKAPKFLIYAASSLQSGVPSRFSGSGSGTDFTLTISSLQPEDFAAYYCQQSHSAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12742 - protein, 216 aa, Artificial Sequence
  Description of Artificial Sequence: Synthetic polypeptide
DIQMTQSPSSLSASVGDRVTITCRASQDVLFYGNVAWYQQKPGKAPKLLIYDGSYLYSGVPSRFSGSGSGTDFTLTISSLQPEDFATYYCQQSYPAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12743 - protein, 222 aa, Artificial Sequence
  Description of Artificial Sequence: Synthetic polypeptide
  Synthetic construct
QLVLTQSSSVSFSLGASAKLTCTLSSQHSTYTIEWYQQQPLKPPKYVMELKKDGSHSTGDGIPDRFSGSSSGADRYLSISNIQPEDEAIYICGVGDTIKEQFVYVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12744 - protein, 704 aa, Artificial Sequence
  Description of Artificial Sequence: Synthetic polypeptide
  Synthetic construct
EVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKSGGGGSGGGGSGGGGSDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSS

SEQ ID NO: 12745 - protein, 214 aa, Artificial Sequence
  Description of Artificial Sequence: Synthetic polypeptide
  Synthetic construct
DIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12746 - protein, 214 aa, Mus musculus
  Ab 4518 LC
DIVMTQSHKFMSTSVGDRVSISCKASQDVIAAVTWYQQKPGQSPKLLIYWASTRHTGVPDRFTGSGSGTDYTLTISSMQAEDLALYYCQQHYSTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12747 - protein, 214 aa, Mus musculus
DIQMTQSPASLSVSVGETVTITCRASENIYSNLAWYQQEQGKSPQLLVYAATNLADGVPSRFSGSGSGTQYSLKINSLQSEDFGSYYCQHFWGTPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12748 - protein, 218 aa, Mus musculus
  Ab 4380/4381 LC
  MOD_RES (40)..(40): Any amino acid
DIVLTQSPASLAVSLGQRATISCRASKSVTTSGYSYMHWXQQKPGQPPKLLISVASNLESGVPARFSGSGSGTDFTLNIHPVEEEDAATFYCHHSRELPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12749 - protein, 214 aa, Mus musculus
  Ab 4382 LC
DIVMTQSLKFMSASVGDRVSITCKASQDVSAAVAWYQQKPGQSPELLIYWASTRHTGVPDRFTGSGSGTDYTLTISSVQAEDLALYYCQQHYTTPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12750 - protein, 214 aa, Mus musculus
  Ab 4383 LC
DIVMTQSHKFMSTSVGDRVSITCKASQDVFTAVAWYQQKPGQSPKLLIYSASSRYTGVPDRFTGSGSGTDFIFTISSVQAEDLAIYHCQQHFGIPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12751 - protein, 214 aa, Mus musculus
  Ab 4385 LC
DIVMTQSQKFMSTSVGDRVSITCKASQNVGTAVSWYQQKPGQSPKLLIFSTSNRYTGVPDRFTGSGSGTDFTLTISNMQSEDLADYFCQQYRSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12752 - protein, 213 aa, Mus musculus
  Ab 4386 LC
QIVLTQSPAIMSASPGEKVTISCSASSSVSYLYWYQQKPGSSPKPWIYRTSNLASGVPARFSGSGSGTSYSLTISSMEAEDAATYYCQQYHNYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12753 - protein, 216 aa, Mus musculus
  Ab 4387 LC
QIVMTQSHKFMSTSVGDRVSITCKASQDVGTAVAWYQQKPGQSPKLLIYWASTRHTGVPDRFTGSGSGTDFTLTISNVQSEDLADYFCQQYSSYPYMYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12754 - protein, 213 aa, Mus musculus
  Ab 4519 LC
QIVLTQSPALMSASPGEKVTMTCSASSSVSYMYWYQQKPRSSPKPWIYLTSNLASGVPARFSGSGSGTSYTLTISSMEAEDAATYYCQQWSSTPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12755 - protein, 217 aa, Artificial Sequence; identical to SEQ ID NO: 7681
  Description of Artificial Sequence: Synthetic polypeptide
  Humanized antibody sequence

SEQ ID NO: 12756 - protein, 217 aa, Artificial Sequence; identical to SEQ ID NO: 7692
  Description of Artificial Sequence: Synthetic polypeptide
  Humanized antibody sequence

SEQ ID NO: 12757 - protein, 217 aa, Artificial Sequence; identical to SEQ ID NO: 7676
  Description of Artificial Sequence: Synthetic polypeptide
  Humanized antibody sequence

SEQ ID NO: 12758 - protein, 217 aa, Artificial Sequence; identical to SEQ ID NO: 7679
  Description of Artificial Sequence: Synthetic polypeptide
  Humanized antibody sequence

SEQ ID NO: 12759 - protein, 217 aa, Artificial Sequence; identical to SEQ ID NO: 7680
  Description of Artificial Sequence: Synthetic polypeptide
  Humanized antibody sequence

SEQ ID NO: 12760 - protein, 222 aa, Artificial Sequence; identical to SEQ ID NO: 7682
  Description of Artificial Sequence: Synthetic polypeptide
  Humanized antibody sequence

SEQ ID NO: 12761 - protein, 111 aa, Artificial Sequence
  Description of Artificial Sequence: Synthetic polypeptide
  Humanized antibody sequence
AYDMTQTPASVEVAVGGTVTIKCQASQSISSWLAWYQQKPGQPPKLLIYEASKLASGVPSRFSGSGSGTQFTLTISGVECADAATYYCQQAYSVANVDNAFGGGTEVVVKR

SEQ ID NO: 12762 - protein, 215 aa, Artificial Sequence; identical to SEQ ID NO: 7685
  Description of Artificial Sequence: Synthetic polypeptide
  Humanized antibody sequence

SEQ ID NO: 12763 - protein, 216 aa, Artificial Sequence; identical to SEQ ID NO: 7686
  Description of Artificial Sequence: Synthetic polypeptide
  Humanized antibody sequence

SEQ ID NO: 12764 - protein, 219 aa, Artificial Sequence; identical to SEQ ID NO: 7687
  Description of Artificial Sequence: Synthetic polypeptide
  Humanized antibody sequence

SEQ ID NO: 12765 - protein, 217 aa, Artificial Sequence; identical to SEQ ID NO: 7688
  Description of Artificial Sequence: Synthetic polypeptide
  Humanized antibody sequence

SEQ ID NO: 12766 - protein, 217 aa, Artificial Sequence; identical to SEQ ID NO: 7689
  Description of Artificial Sequence: Synthetic polypeptide
  Humanized antibody sequence

SEQ ID NO: 12767 - protein, 217 aa, Artificial Sequence; identical to SEQ ID NO: 7690
  Description of Artificial Sequence: Synthetic polypeptide
  Humanized antibody sequence

SEQ ID NO: 12768 - protein, 217 aa, Artificial Sequence; identical to SEQ ID NO: 7691
  Description of Artificial Sequence: Synthetic polypeptide
  Humanized antibody sequence

SEQ ID NO: 12769 - protein, 219 aa, Artificial Sequence; identical to SEQ ID NO: 7693
  Description of Artificial Sequence: Synthetic polypeptide
  Humanized antibody sequence

SEQ ID NO: 12770 - protein, 219 aa, Artificial Sequence; identical to SEQ ID NO: 7694
  Description of Artificial Sequence: Synthetic polypeptide
  Humanized antibody sequence

SEQ ID NO: 12771 - protein, 217 aa, Artificial Sequence; identical to SEQ ID NO: 7695
  Description of Artificial Sequence: Synthetic polypeptide
  Humanized antibody sequence

SEQ ID NO: 12772 - protein, 217 aa, Artificial Sequence; identical to SEQ ID NO: 7696
  Description of Artificial Sequence: Synthetic polypeptide
  Humanized antibody sequence

SEQ ID NO: 12773 - protein, 217 aa, Artificial Sequence; identical to SEQ ID NO: 7697
  Description of Artificial Sequence: Synthetic polypeptide
  Humanized antibody sequence

SEQ ID NO: 12774 - protein, 217 aa, Artificial Sequence; identical to SEQ ID NO: 7698
  Description of Artificial Sequence: Synthetic polypeptide
  Humanized antibody sequence

SEQ ID NO: 12775 - protein, 217 aa, Artificial Sequence; identical to SEQ ID NO: 7699
  Description of Artificial Sequence: Synthetic polypeptide
  Humanized antibody sequence

SEQ ID NO: 12776 - protein, 217 aa, Artificial Sequence; identical to SEQ ID NO: 7700
  Description of Artificial Sequence: Synthetic polypeptide
  Humanized antibody sequence

SEQ ID NO: 12777 - protein, 216 aa, Artificial Sequence; identical to SEQ ID NO: 7701
  Description of Artificial Sequence: Synthetic polypeptide
  Humanized antibody sequence

SEQ ID NO: 12778 - protein, 216 aa, Artificial Sequence; identical to SEQ ID NO: 7702
  Description of Artificial Sequence: Synthetic polypeptide
  Humanized antibody sequence

SEQ ID NO: 12779 - protein, 218 aa, Artificial Sequence; identical to SEQ ID NO: 7677
  Description of Artificial Sequence: Synthetic polypeptide
  Humanized antibody sequence

SEQ ID NO: 12780 - protein, 217 aa, Artificial Sequence; identical to SEQ ID NO: 7678
  Description of Artificial Sequence: Synthetic polypeptide
  Humanized antibody sequence

SEQ ID NO: 12781 - protein, 220 aa, Unknown
  Description of Unknown: light chain 5D5 Fab sequence
DIMMSQSPSSLTVSVGEKVTVSCKSSQSLLYTSSQKNYLAWYQQKPGQSPKLLIYWASTRESGVPDRFTGSGSGTDFTLTITSVKADDLAVYYCQQYYAYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12782 - protein, 129 aa, Artificial Sequence
  Description of Artificial Sequence: Synthetic polypeptide
  HGF 1.24.1 Vk, 1-L15
MDMRVPAQLLGLLLLWFPGSRCDIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIK

SEQ ID NO: 12783 - protein, 133 aa, Artificial Sequence
  Description of Artificial Sequence: Synthetic polypeptide
  HGF 1.29.1 Vk, 4-B3
MVLQTQVFISLLLWISDAYGDIVMTQSPDSLAVSLGERATINCKSSQSIFYSSTNKNYLAWYQKKPGQPPKLLIYWASTRESGVPDRFSGSGSGTDFTLTISSLQAEDVAVYYCQQYYSTPWTFGQGTKVEIK

SEQ ID NO: 12784 - protein, 129 aa, Artificial Sequence
  Description of Artificial Sequence: Synthetic polypeptide
  HGF 1.60.1 Vk, 1-A20
MDMRVPAQLLGLLLLWLPDTRCDIQMTQSPSSLSVSVGDRVTITCRASQGISSYLAWYQQKPGKVPKLLIYVASTLQSGVPSRFSGSGSGTDFTLTISSLQPEDVATYYCQNYNSDPLTFGGGTKVEIK

SEQ ID NO: 12785 - protein, 129 aa, Artificial Sequence
  Description of Artificial Sequence: Synthetic polypeptide
  HGF 1.61.3 Vk, 1-018/08
MDMRVPAQLLGLLLLWLSGARCDIQMTQSPSSLSASVGDRVTITCQASQDISNYLNWYQQKPGTAPKLLIYGASDLETGVPSRFSGSGSGTDFTFAISSLQPEDIATYYCQQYDNLPYNFGQGTKLEIK

SEQ ID NO: 12786 - protein, 129 aa, Artificial Sequence
  Description of Artificial Sequence: Synthetic polypeptide
  HGF 1.74.3 Vk, 1-012/02
MDMRVPAQLLGLLLLWLRGARCDIQMTQSPSSLSASVGDRVTITCRASQSINSDLNWYQQKPGKVPKLLIYVASSLQNGVPSRFSGSGSGTDFTLTISSLQPEDFATYYCQRSYSTPPTFGPGTKVDIK

SEQ ID NO: 12787 - protein, 129 aa, Artificial Sequence
  Description of Artificial Sequence: Synthetic polypeptide
  HGF 1.75.1 Vk, A-130
MDMRVPAQLLGLLLLWFPGARCDIQMTQSPSSLSASVGDRVTITCRASQGIRNDLGWFQQKPGKAPKRLIYAASSLQSGVPSRFSGSGSGTEFTLTISSLQPEDFATYYCLQHDSYPLTFGGGTKVEIK

SEQ ID NO: 12788 - protein, 133 aa, Artificial Sequence
  Description of Artificial Sequence: Synthetic polypeptide
  HGF 2.4.4 Vk, 4-B3
MVLQTQVFISLLLWISGAYGDIVMTQSPDSLAVSLGERATINCKSSQSVLFSSNNKNYLAWYQQKPGQPPKLLIYWASTRESGVPDRFSGSGSGTDFTLTISSLQAEDVAVYYCQQYFSPPWTFGQGTKVEIK

SEQ ID NO: 12789 - protein, 128 aa, Artificial Sequence
  Description of Artificial Sequence: Synthetic polypeptide
  HGF 2.12.1 Vk, 3-L2/L16
MEAPAQLLFLLLLWLPDTTGEIVMTQSPATLSVSPGERATLSCRASQSVDSNLAWYRQKPGQAPRLLIYGASTRATGIPARFSGSGSGTEFTLTISSLQSEDFAVYYCQQYINWPPITFGQGTRLEIK

SEQ ID NO: 12790 - protein, 129 aa, Artificial Sequence
  Description of Artificial Sequence: Synthetic polypeptide
  HGF 2.40.1 Vk, 1A20
MDMRVPAQLLGLLLLWFPGARCDIQMTQSPSSLSASVGDRVTITCRASQGIRNDLGWYQQKPGKAPKRLIYVASSLQSGVPSRFSGSGSGTEFTLTISSLQPEDFATYYCLQHNSYPLTFGGGTKVEIK

SEQ ID NO: 12791 - protein, 128 aa, Artificial Sequence
  Description of Artificial Sequence: Synthetic polypeptide
  HGF Vk, 3-L2/L16
MEAPAQLLFLLLLWLPDTTGEIVMTQSPATLSVSPGERATLSCRASQSVSSNLAWYQQKPGQAPRLLMYGASTRATGIPARFSGSGSGTEFTLTISSLQSEDFAVYYCQQYNNWPPITFGQGTRLEIK

SEQ ID NO: 12792 - protein, 234 aa, Artificial Sequence
  Description of Artificial Sequence: Synthetic polypeptide
  HuL2G7 light chain
MEAPAQLLFLLLLWLPDTHGDIVMTQSPSSLSASVGDRVTITCKASENVVTYVSWYQQKPGKAPKLLIYGASNRYTGVPDRFSGSGSGTDFTLTISSLQPEDFATYYCGQGYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12793 - protein, 106 aa, Artificial Sequence
  Description of Artificial Sequence: Synthetic polypeptide
DIVMTQSPDSLAVSLGERATINCRASSSVSYMHWYQQKPGQPPKLLIYGTSKLASGVPDRFSGSGSGTDFTLTISSLQAEDVAVYYCLQRSSYPPTFGQGTKVEIK

SEQ ID NO: 12794 - protein, 128 aa, Artificial Sequence
  Description of Artificial Sequence: Synthetic polypeptide
MDFQVQSFSLLLISITVIVSSGDIVMTQSPDSLAVSLGERATINCRASSSVSYMHWYQQKPGQPPKLLIYGTSKLASGVPDRFSGSGSGTDFTLTISSLQAEDVAVYYCLQRSSYPPTFGQGTKVEIK

SEQ ID NO: 12795 - protein, 212 aa, Homo sapiens
DIELTQPPSVSVAPGQTARISCSGDNIPLKYVSWYQQKPGQAPVLVIHDDNKRPSGIPERFSGSNSGNTATLTISGTQAEDEADYYCQSWASTGVVFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 12796 - protein, 113 aa, Artificial Sequence
  Description of Artificial Sequence: Synthetic polypeptide
DVLMTQTPLSLPVSLGDQASISCRSSQSIVHSNVNTYLEWYLQKPGQSPKLLIYKVSNRFSGVPDRFSGSGSGTDFTLRISRVEAEDLGIYYCFQGSHVPPTFGGGTKLEIKR

SEQ ID NO: 12797 - protein, 113 aa, Artificial Sequence
  Description of Artificial Sequence: Synthetic polypeptide
DVLMTQTPLSLPVSLGDQASISCRSSQSIVHSNGNTYLEWYLQKPGQSPKLLIYSISSRFSGVPDRFSGSGSGTDFTLKISRVQAEDLGVYYCFQGSHVPYTFGGGTKLEIKR

SEQ ID NO: 12798 - protein, 113 aa, Artificial Sequence
  Description of Artificial Sequence: Synthetic polypeptide
DVLMTQTPLSLPVSLGDQASISCRSSQTIVHSNGNTYLEWYLQKPGQSPKLLIYKVTNRFSGVPDRFSGSGSGTDFTLKISRVEAEDLGVYYCFQGTHAPYTFGGGTKLEIKR

SEQ ID NO: 12799 - protein, 113 aa, Artificial Sequence
  Description of Artificial Sequence: Synthetic polypeptide
DVLMTQTPLSLPVSLGDQASISCRFSQSIVHSNGNTYLEWYLQKSGQSPKLLIYKVSNRFSGVPDRFSGSGSGTDFTLKISRVEAEDLGVYYCFQGSHVPRTFGGGTKLEIKR

SEQ ID NO: 12800 - protein, 113 aa, Artificial Sequence
  Description of Artificial Sequence: Synthetic polypeptide
ELVMTQTPLSLPVSLGDQASISCRSSQTIVHSNGDTYLDWFLQKPGQSPKLLIYKVSNRFSGVPDRFSGSGSGTDFTLKISRVEAEDLGVYYCFQGSHVPPTFGGGTKLEIKR

SEQ ID NO: 12801 - protein, 113 aa, Artificial Sequence
  Description of Artificial Sequence: Synthetic polypeptide
DVLMTQTPLSLPVSLGDQASISCRSNQTILLSDGDTYLEWYLQKPGQSPKLLIYKVSNRFSGVPDRFSGSGSGTDFTLKISRVEAEDLGVYYCFQGSHVPPTFGGGTKLEIKR

SEQ ID NO: 12802 - protein, 113 aa, Artificial Sequence
  Description of Artificial Sequence: Synthetic polypeptide
DVLMTQTPLSLPVSLGDQASISCKSSQSIVHSSGNTYFEWYLQKPGQSPKLLIYKVSNRFSGVPDRFSGSGSGTDFTLKISRVEAEDLGVYYCFQGSHIPFTFGSGTKLEIKR

SEQ ID NO: 12803 - protein, 113 aa, Artificial Sequence
  Description of Artificial Sequence: Synthetic polypeptide
DVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKR

SEQ ID NO: 12804 - protein, 113 aa, Artificial Sequence
  Description of Artificial Sequence: Synthetic polypeptide
  MOD_RES (28)..(28): Any naturally occurring amino acid
  MOD_RES (101)..(101): Any naturally occurring amino acid
DVLMTQTPLSLPVSLGDQASISCRSSQXIVHSNGNTYLEWYLQKPGQSPKLLIYKVSNRFSGVPDRFSGSGSGTDFTLKISRVEAEDLGVYYCFQGSHVPXTFGGGTKLEIKR

SEQ ID NO: 12805 - protein, 128 aa, Homo sapiens; identical to SEQ ID NO: 8055

SEQ ID NO: 12806 - protein, 129 aa, Homo sapiens
MDMRVPAQLLGLLLLWLPGARCAIQLTQSPSSLSASVGDRVTITCRASQGISSVLAWYQQKPGKAPKLLIYDASSLESGVPSRFSGSGSGTDFTLTISSLQPEDFATYYCQQFNSYPYTFGQGTKLEIK

SEQ ID NO: 12807 - protein, 130 aa, Homo sapiens
METPAQLLFLLLLWLPDTTGEIVLTQSPGTLSLSPGERATLSCRASQSVSRSYLAWYQQKPGQAPRLLIYGASSRATGIPDRFSGSGSGTDFTLTISRLEPEDFAVYCCQQYGSSPWTFGQGTKVEIKRT

SEQ ID NO: 12808 - protein, 112 aa, Artificial Sequence [sequence omitted]

SEQ ID NO: 12809 - protein, 238 aa, Artificial Sequence
  Description of Artificial Sequence: Synthetic polypeptide
  Chimeric variable heavy chain comprising sequences from mus musculus and homo sapiens
MKLPVRLVVLMFWIPASSSDVLMTQTPLSLPVSLGDHASISCRSSQSIVQSNGDTYLEWYLQKPGQSPKLLIYRISNRFSGVPDRFSGSGSGTDFTLKISRVEAEDLGVYYCFQGSHVPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12810 - protein, 108 aa, Artificial Sequence
  Description of Artificial Sequence: Synthetic polypeptide
  Completely synthetic amino acid
ENVLTQSPAIMSASPGEKVTMTCGASSSVSSSFLHWYQQKSGASPKLWIYSTSNLASGVPTRFSGSGSGTSYSLTISSVEAEDAATYYCQQYSGYPLTFGAGTKLELK

SEQ ID NO: 12811 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPFTFGSGTKLDIK

SEQ ID NO: 12812 - protein, 112 aa, Homo sapiens [sequence omitted]

SEQ ID NO: 12813 - protein, 112 aa, Mus musculus
DIVMSQSPSSLAVSAGEKVTMNCKSSQSLLDSRTRKNYLAWYQQKPGQSPKLLIYWASTRESGVPDRFTGSGSGTDFTLTISSVQAEDLAVYYCKQSYNLFTFGGGTKLEIK

SEQ ID NO: 12814 - protein, 112 aa, Artificial Sequence
  Description of Artificial Sequence: Synthetic polypeptide
  Chemically synthesized humanized antibody, light chain
DIVMTQSPDSLAVSLGERATINCKSSQSLLDSRTRKNYLAWYQQKPGQPPKLLIYWASTRESGVPDRFSGSGSGTDFTLTISSLQAEDVAVYYCKQSYNLFTFGGGTKVEIK

SEQ ID NO: 12815 - protein, 219 aa, Artificial Sequence
  Description of Artificial Sequence: Synthetic polypeptide
  Humanized
DIVMTQSPLSLPVTPGEPASISCRSSQNIVHINGNTYLEWYLQKPGQSPRLLIYKISDRFSGVPDRFSGSGSGTDFTLKISRVEADDVGIYYCFQGSHVPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12816 - protein, 449 aa, Artificial Sequence
  Description of Artificial Sequence: Synthetic polypeptide
  Humanised
QVQLVQSGAEVKKPGSSVKVSCKASGFYIKDTYMHWVRQAPGQGLEWMGTIDPANGNTKYVPKFQGRVTITADESTSTAYMELSSLRSEDTAVYYCARSIYDDYHYDDYYAMDYWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 12817 - protein, 214 aa, Artificial Sequence
  Description of Artificial Sequence: Synthetic polypeptide
  Humanized
DIQMTQSPSSVSASVGDRVTITCLASEDIYTYLTWYQQKPGKAPKLLIYGANKLQDGVPSRFSGSGSGTDYTLTISSLQPEDFATYYCLQGSKFPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12818 - protein, 132 aa, Unknown
  Description of Unknown: Murinae gen. sp. sequence
METDTILLWVLLLWVPGSTGDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPPTFGGGTKLEIKR

SEQ ID NO: 12819 - protein, 131 aa, Artificial Sequence
  Description of Artificial Sequence: Synthetic polypeptide
  Synthetic construct
MGWSCIILFLVATATGVHSDIVMTQSPDSLAVSLGERATINCKASQSVDYDGDSYMNWYQQKPGQPPKLLIYAASNLESGVPDRFSGSGSGTDFTLTISSLQAEDVAVYYCQQSNEDPPRFGGGTKVEIKR

SEQ ID NO: 12820 - protein, 216 aa, Artificial Sequence
  Description of Artificial Sequence: Synthetic polypeptide
  Humanised
DIVLTQSPSSLSASVGDRVTITCKASQSVDYDGDSYMNWYQQKPGKAPKLLIYANLESGIPSRFSGSGSGTDFTFTISSLQPEDIATYYCQQSNEDPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12821 - protein, 220 aa, Artificial Sequence
  Description of Artificial Sequence: Synthetic polypeptide
  Humanised
DIVMTQSPDSLAVSLGERATINCKSSQSLLNSGNQKNYLAWYQQKPGQPPKLLIYGASTRESGVPDRFSGSGSGTDFTLTISSLQAEDVAVYYCQNVHSFPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12822 - protein, 163 aa, Oryctolagus cuniculus; identical to SEQ ID NO: 7745

SEQ ID NO: 12823 - protein, 164 aa, Oryctolagus cuniculus; identical to SEQ ID NO: 7738

SEQ ID NO: 12824 - protein, 100 aa, Oryctolagus cuniculus; identical to SEQ ID NO: 7739

SEQ ID NO: 12825 - protein, 123 aa, Oryctolagus cuniculus; identical to SEQ ID NO: 7740

SEQ ID NO: 12826 - protein, 123 aa, Oryctolagus cuniculus; identical to SEQ ID NO: 7741

SEQ ID NO: 12827 - protein, 123 aa, Oryctolagus cuniculus; identical to SEQ ID NO: 7742

SEQ ID NO: 12828 - protein, 123 aa, Oryctolagus cuniculus; identical to SEQ ID NO: 7743

SEQ ID NO: 12829 - protein, 119 aa, Oryctolagus cuniculus; identical to SEQ ID NO: 7744

SEQ ID NO: 12830 - protein, 99 aa, Oryctolagus cuniculus; identical to SEQ ID NO: 7746

SEQ ID NO: 12831 - protein, 119 aa, Oryctolagus cuniculus; identical to SEQ ID NO: 7747

SEQ ID NO: 12832 - protein, 170 aa, Oryctolagus cuniculus; identical to SEQ ID NO: 7748

SEQ ID NO: 12833 - protein, 123 aa, Oryctolagus cuniculus; identical to SEQ ID NO: 7749

SEQ ID NO: 12834 - protein, 125 aa, Oryctolagus cuniculus; identical to SEQ ID NO: 7750

SEQ ID NO: 12835 - protein, 123 aa, Oryctolagus cuniculus; identical to SEQ ID NO: 7751

SEQ ID NO: 12836 - protein, 123 aa, Oryctolagus cuniculus; identical to SEQ ID NO: 7752

SEQ ID NO: 12837 - protein, 120 aa, Oryctolagus cuniculus; identical to SEQ ID NO: 7753

SEQ ID NO: 12838 - protein, 122 aa, Oryctolagus cuniculus; identical to SEQ ID NO: 7754

SEQ ID NO: 12839 - protein, 123 aa, Oryctolagus cuniculus; identical to SEQ ID NO: 7755

SEQ ID NO: 12840 - protein, 121 aa, Oryctolagus cuniculus; identical to SEQ ID NO: 7756

SEQ ID NO: 12841 - protein, 123 aa, Oryctolagus cuniculus; identical to SEQ ID NO: 7757

SEQ ID NO: 12842 - protein, 121 aa, Oryctolagus cuniculus; identical to SEQ ID NO: 7758

SEQ ID NO: 12843 - protein, 165 aa, Oryctolagus cuniculus; identical to SEQ ID NO: 7759

SEQ ID NO: 12844 - protein, 120 aa, Oryctolagus cuniculus; identical to SEQ ID NO: 7760

SEQ ID NO: 12845 - protein, 124 aa, Oryctolagus cuniculus; identical to SEQ ID NO: 7761

SEQ ID NO: 12846 - protein, 124 aa, Oryctolagus cuniculus; identical to SEQ ID NO: 7762

SEQ ID NO: 12847 - protein, 124 aa, Oryctolagus cuniculus; identical to SEQ ID NO: 7763

SEQ ID NO: 12848 - protein, 124 aa, Oryctolagus cuniculus; identical to SEQ ID NO: 7764

SEQ ID NO: 12849 - protein, 121 aa, Oryctolagus cuniculus; identical to SEQ ID NO: 7765

SEQ ID NO: 12850 - protein, 122 aa, Oryctolagus cuniculus; identical to SEQ ID NO: 7766

SEQ ID NO: 12851 - protein, 122 aa, Oryctolagus cuniculus; identical to SEQ ID NO: 7767

SEQ ID NO: 12852 - protein, 124 aa, Oryctolagus cuniculus; identical to SEQ ID NO: 7768

SEQ ID NO: 12853 - protein, 121 aa, Oryctolagus cuniculus; identical to SEQ ID NO: 7769

SEQ ID NO: 12854 - protein, 164 aa, Oryctolagus cuniculus; identical to SEQ ID NO: 7770

SEQ ID NO: 12855 - protein, 122 aa, Oryctolagus cuniculus; identical to SEQ ID NO: 7771

SEQ ID NO: 12856 - protein, 122 aa, Oryctolagus cuniculus; identical to SEQ ID NO: 7772

SEQ ID NO: 12857 - protein, 111 aa, Oryctolagus cuniculus; identical to SEQ ID NO: 7774

SEQ ID NO: 12858 - protein, 111 aa, Artificial Sequence; identical to SEQ ID NO: 7778
  Description of Artificial Sequence: Synthetic polypeptide
  Humanized antibody

SEQ ID NO: 12859 - protein, 122 aa, Oryctolagus cuniculus; identical to SEQ ID NO: 7779

SEQ ID NO: 12860 - protein, 216 aa, Oryctolagus cuniculus; identical to SEQ ID NO: 7780

SEQ ID NO: 12861 - protein, 122 aa, Oryctolagus cuniculus; identical to SEQ ID NO: 7781

SEQ ID NO: 12862 - protein, 123 aa, Oryctolagus cuniculus; identical to SEQ ID NO: 7782

SEQ ID NO: 12863 - protein, 123 aa, Oryctolagus cuniculus; identical to SEQ ID NO: 7783

SEQ ID NO: 12864 - protein, 122 aa, Oryctolagus cuniculus; identical to SEQ ID NO: 7784

SEQ ID NO: 12865 - protein, 122 aa, Oryctolagus cuniculus; identical to SEQ ID NO: 7785

SEQ ID NO: 12866 - protein, 122 aa, Oryctolagus cuniculus; identical to SEQ ID NO: 7786

SEQ ID NO: 12867 - protein, 164 aa, Oryctolagus cuniculus; identical to SEQ ID NO: 7787

SEQ ID NO: 12868 - protein, 217 aa, Oryctolagus cuniculus; identical to SEQ ID NO: 7788

SEQ ID NO: 12869 - protein, 112 aa, Oryctolagus cuniculus; identical to SEQ ID NO: 7789

SEQ ID NO: 12870 - protein, 217 aa, Oryctolagus cuniculus; identical to SEQ ID NO: 7790

SEQ ID NO: 12871 - protein, 235 aa, Oryctolagus cuniculus; identical to SEQ ID NO: 7791

SEQ ID NO: 12872 - protein, 111 aa, Oryctolagus cuniculus; identical to SEQ ID NO: 7792

SEQ ID NO: 12873 - protein, 164 aa, Oryctolagus cuniculus; identical to SEQ ID NO: 7793

SEQ ID NO: 12874 - protein, 219 aa, Artificial Sequence; identical to SEQ ID NO: 7710
  Description of Artificial Sequence: Synthetic polypeptide
  Antibody A light chain

SEQ ID NO: 12875 - protein, 238 aa, Artificial Sequence
  Description of Artificial Sequence: Synthetic polypeptide
  AntiMET-R light chain
METDTILLWVLLLWVPGSTGDIVLTQSPASLAVSLGQRATISCKASQSVDYDGGSYMSWFQQRPGQPPKLLISAASNLESGIPARFSGSGSGTDFTLNIHPVEEEDVATYYCQQSYEDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 12876 - protein, 214 aa, Homo sapiens; identical to SEQ ID NO: 9500

SEQ ID NO: 12877 - protein, 235 aa, Mus musculus; identical to SEQ ID NO: 9486

SEQ ID NO: 12878 - protein, 108 aa, Mus musculus; identical to SEQ ID NO: 9397

SEQ ID NO: 12879 - protein, 446 aa, Artificial Sequence
  Description of Artificial Sequence: Synthetic polypeptide
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 12880 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 12881 - protein, 263 aa, Artificial Sequence [sequence omitted]

SEQ ID NO: 12882 - protein, 107 aa, Artificial Sequence; identical to SEQ ID NO: 12615
  Description of Artificial Sequence: Synthetic polypeptide

SEQ ID NO: 12883 - protein, 107 aa, Artificial Sequence
  Description of Artificial Sequence: Synthetic polypeptide
DIQMTQSPSSLSASVGDRVTITCGVSQDVDSVVSWYQQKPGKAPKLLIYSASFLYSGVPSRFSGSGSGTDFTLTISSLQPEDFATYYCQQSYTTPPTFGQGTKVEIK

SEQ ID NO: 12884 - protein, 107 aa, Artificial Sequence
  Description of Artificial Sequence: Synthetic polypeptide
DIQMTQSPSSLSASVGDRVTITCGASHNLGTVIAWYQQKPGKAPKLLIYSASFLYSGVPSRFSGSGSGTDFTLTISSLQPEDFATYYCQQSYTTPPTFGQGTKVEIK

SEQ ID NO: 12885 - protein, 107 aa, Artificial Sequence
  Description of Artificial Sequence: Synthetic polypeptide
DIQMTQSPSSLSASVGDRVTITCRASQDVSTAVAWYQQKPGKAPKLLIYNQEFVYSGVPSRFSGSGSGTDFTLTISSLQPEDFATYYCQQSYTTPPTFGQGTKVEIK

SEQ ID NO: 12886 - protein, 107 aa, Artificial Sequence
  Description of Artificial Sequence: Synthetic polypeptide
DIQMTQSPSSLSASVGDRVTITCRASQIVGTFVAWYQQKPGKAPKLLIYSASFLYSGVPSRFSGSGSGTDFTLTISSLQPEDFATYYCQQSYTTPPTFGQGTKVEIK

SEQ ID NO: 12887 - protein, 107 aa, Artificial Sequence
  Description of Artificial Sequence: Synthetic polypeptide
DIQMTQSPSSLSASVGDRVTITCRASQDVETFVAWYQQKPGKAPKLLIYSASFLYSGVPSRFSGSGSGTDFTLTISSLQPEDFATYYCQQSYTTPPTFGQGTKVEIK

SEQ ID NO: 12888 - protein, 214 aa, Artificial Sequence
  Description of Artificial Sequence: Synthetic polypeptide
  Light chain anti-Tac (wt IgG)
MQIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12889 - protein, 110 aa, Homo sapiens
QSVLTQPPSASGTPGQRVTISCSGSSSNLGSNFVYWYQQLPGTAPKLLIYRNHQRPSGVPDRFSGSKSGTSASLAISGLRSEDEADYYCASWDDSLRVVVFGGGTKLTVL

SEQ ID NO: 12890 - protein, 110 aa, Homo sapiens
SYVLTQPPSASGTPGQRVTISCSGSSSNIGINYVYWYQQLPGTAPKLLIYRNDQRPSGVPDRFSGSKSGTSASLAISGLRSEDEADYYCATWDDSLSGVVFGGGTKVTVL

SEQ ID NO: 12891 - protein, 107 aa, Artificial Sequence
  Description of Artificial Sequence: Synthetic polypeptide
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGQGTKLELK

SEQ ID NO: 12892 - protein, 107 aa, Artificial Sequence
  Description of Artificial Sequence: Synthetic polypeptide
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGQGTKLELK

SEQ ID NO: 12893 - protein, 214 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12894 - protein, 214 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYPTPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12895 - protein, 220 aa, Artificial Sequence
  Description of Artificial Sequence: Synthetic polypeptide
DIQMTQSPSSLSASVGDRVTITCRASQALGDSENGYADVAWYQQKPGKAPKLLIYEGSSLYSGVPSRFSGSGSGTDFTLTISSLQPEDFATYYCQQAAPSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12896 - protein, 220 aa, Artificial Sequence
  Description of Artificial Sequence: Synthetic polypeptide
DIQMTQSPSSLSASVGDRVTITCRASQSLLASHDGTPWVAWYQQKPGKAPKLLIYDASYLYSGVPSRFSGSGSGTDFTLTISSLQPEDFATYYCQQSTFAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12897 - protein, 214 aa, Artificial Sequence
  Description of Artificial Sequence: Synthetic polypeptide
DIQMTQSPSSLSASVGDRVTITCRASQEIFPDVAWYQQKPGKAPKLLIYSASSLYSGVPSRFSGSGSGTDFTLTISSLQPEDFATYYCQQAAPTPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12898 - protein, 214 aa, Artificial Sequence
  Description of Artificial Sequence: Synthetic polypeptide
DIQMTQSPSSLSASVGDRVTITCRASQAIASDVAWYQQKPGKAPKLLIYSASFLYSGVPSRFSGSGSGTDFTLTISSLQPEDFATYYCQQSEPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12899 - protein, 214 aa, Artificial Sequence
  Description of Artificial Sequence: Synthetic polypeptide
DIQMTQSPSSLSASVGDRVTITCRASQDVGSDLAWYQQKPGKAPKLLIYSASYLYSGVPSRFSGSGSGTDFTLTISSLQPEDFATYYCQQSDPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12900 - protein, 214 aa, Artificial Sequence
  Description of Artificial Sequence: Synthetic polypeptide
DIQMTQSPSSLSASVGDRVTITCRASQNIASDVAWYQQKPGKAPKLLIYSASSLYSGVPSRFSGSGSGTDFTLTISSLQPEDFATYYCQQSDPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12901 - protein, 214 aa, Artificial Sequence
  Description of Artificial Sequence: Synthetic polypeptide
DIQMTQSPSSLSASVGDRVTITCRASQDLATDVAWYQQKPGKAPKLLIYSASFLYSGVPSRFSGSGSGTDFTLTISSLQPEDFATYYCQQSEPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12902 - protein, 214 aa, Artificial Sequence; identical to SEQ ID NO: 7654
  Description of Artificial Sequence: Synthetic polypeptide

SEQ ID NO: 12903 - protein, 218 aa, Artificial Sequence
  Description of Artificial Sequence: Synthetic polypeptide
DIQMTQSPSSLSASVGDRVTITCRASQAVWGGYIAPVAWYQQKPGKAPKLLIYDGSYLYSGVPSRFSGSGSGTDFTLTISSLQPEDFATYYCQQRLPTPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12904 - protein, 218 aa, Artificial Sequence
  Description of Artificial Sequence: Synthetic polypeptide
DIQMTQSPSSLSASVGDRVTITCRANQSIAGAYYAPVAWYQQKPGKAPKLLIYDGYFLYSGVPSRFSGSGSGTDFTLTISSLQPEDFATYYCQQRLPSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12905 - protein, 218 aa, Artificial Sequence
  Description of Artificial Sequence: Synthetic polypeptide
DIQMTQSPSSLSASVGDRVTITCRASQSLWAAYFAPVAWYQQKPGKAPKLLIYDGSYLYSGVPSRFSGSGSGTDFTLTISSLQPEDFATYYCQQRLPSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12906 - protein, 107 aa, Artificial Sequence
  Description of Artificial Sequence: Synthetic polypeptide
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIK

SEQ ID NO: 12907 - protein, 214 aa, Artificial Sequence
  Description of Artificial Sequence: Synthetic polypeptide
DIVMTQTPLSLPVTPGEPASISCKASQDVGTAVAWYLQKPGQSPQLLIYWASTRHTGIPARFSGSGSGTEFTLTISSLQSEDFAVYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12908 - protein, 107 aa, Artificial Sequence
  Description of Artificial Sequence: Synthetic polypeptide
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIK

SEQ ID NO: 12909 - protein, 214 aa, Artificial Sequence
  Description of Artificial Sequence: Synthetic polypeptide
DIQMTQSPSSLSASVGDRVTITCKASQDVGTAVAWYLQKPGQSPQLLIYWASTRHTGVPSRFSGSGSGTDFTLTISSLQPEDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12910 - protein, 107 aa, Artificial Sequence
  Description of Artificial Sequence: Synthetic polypeptide
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 12911 - protein, 214 aa, Artificial Sequence
  Description of Artificial Sequence: Synthetic polypeptide
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12912 - protein, 107 aa, Artificial Sequence
  Description of Artificial Sequence: Synthetic polypeptide
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 12913 - protein, 214 aa, Artificial Sequence
  Description of Artificial Sequence: Synthetic polypeptide
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12914 - protein, 107 aa, Artificial Sequence
  Description of Artificial Sequence: Synthetic polypeptide
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 12915 - protein, 214 aa, Artificial Sequence
  Description of Artificial Sequence: Synthetic polypeptide
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12916 - protein, 107 aa, Artificial Sequence
  Description of Artificial Sequence: Synthetic polypeptide
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 12917 - protein, 214 aa, Artificial Sequence
  Description of Artificial Sequence: Synthetic polypeptide
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12918 - protein, 214 aa, Artificial Sequence
  Description of Artificial Sequence: Synthetic polypeptide
DIQMTQSPSSLSASVGDRVTITCKASQDVGTAVAWYQQKPGQAPRLLIYWASTRHTGVPSRFSGSGSGTDFTFTISSLQPEDIATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12919 - protein, 107 aa, Artificial Sequence
  Description of Artificial Sequence: Synthetic polypeptide
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 12920 - protein, 214 aa, Artificial Sequence
  Description of Artificial Sequence: Synthetic polypeptide
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12921 - protein, 107 aa, Artificial Sequence
  Description of Artificial Sequence: Synthetic polypeptide
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 12922 - protein, 214 aa, Artificial Sequence
  Description of Artificial Sequence: Synthetic polypeptide
EIVLTQSPDFQSVTPKEKVTITCKASQDVGTAVAWYQQKPGQAPRLLIYWASTRHTGVPSRFSGSGSGTEFTLTISSLQPDDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12923 - protein, 216 aa, Rattus sp.
QAVVTQANSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 12924 - protein, 238 aa, Homo sapiens
MGWSCIILFLVATATGVHSDIVMTQSPLSLPVTPGEPASISCRSSQSIVQSNGDTYLEWYLQKPGQSPQLLIYRVSNRFSGVPDRFSGSGSGTDFTLKISRVEAEDVGVYYCFQGSHVPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12925 - protein, 107 aa, Artificial Sequence
  Description of Artificial Sequence: Synthetic polypeptide
  light chain consensus sequence
DIQMTQSPSSLSASVGDRVTITCRASQSISNYLAWYQQKPGKAPKLLIYAASSLESGVPSRFSGSGSGTDFTLTISSLQPEDFATYYCQQYNSLPWTFGQGTKVEIK

SEQ ID NO: 12926 - protein, 106 aa, Artificial Sequence; identical to SEQ ID NO: 3203
  Description of Artificial Sequence: Synthetic polypeptide

SEQ ID NO: 12927 - protein, 233 aa, Artificial Sequence
  Description of Artificial Sequence: Synthetic polypeptide
  Synthetic construct
MDWTWRILFLVAAATGVHSDIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKRTVAAPSVFIFPPSDEQLKSGTASVVCLLNNVYPREAKVQWKVDNALQSGNSQESVTEQDSKDSTYSLSSTLTLSKADYEKGKVYACEVTHQHLSSPVTKSFNRGEC

SEQ ID NO: 12928 - protein, 105 aa, Homo sapiens
QPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 12929 - protein, 128 aa, Artificial Sequence; identical to SEQ ID NO: 8051
  Description of Artificial Sequence: Synthetic polypeptide

SEQ ID NO: 12930 - protein, 112 aa, Mus musculus; identical to SEQ ID NO: 9059

SEQ ID NO: 12931 - protein, 118 aa, Mus musculus
DVQLQESGPGLVKPSQSLSLTCSVTGYSITSGYYWNWIRQFPGNKLEWMGYINYDGNNNYNPSLKNRISITRDTSKNQFFLKLNSVTTEDTATYYCAREGYGYFFDYWGQGTTLTVSS

SEQ ID NO: 12932 - protein, 123 aa, Homo sapiens
QVQLQESGPGLVKPSETLSLTCTVSGYSISSGYYWSWIRQPPGKGLEWIGSMFHSGSSYYNPSLKSRVTISVDTSKNQFSLQLRSVTAADTAVYYCARGRYCSSTSCNWFDPWGQGTLVTVSS

SEQ ID NO: 12933 - protein, 107 aa, Homo sapiens [sequence omitted]

SEQ ID NO: 12934 - protein, 106 aa, Artificial Sequence
  Description of Artificial Sequence: Synthetic polypeptide
  Cetuximab A213 kappa light chain constant domain
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 12935 - protein, 107 aa, Artificial Sequence [sequence omitted]

SEQ ID NO: 12936 - protein, 104 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 12937 - protein, 128 aa, Artificial Sequence; identical to SEQ ID NO: 8052
  Description of Artificial Sequence: Synthetic polypeptide

SEQ ID NO: 12938 - protein, 128 aa, Artificial Sequence; identical to SEQ ID NO: 8053
  Description of Artificial Sequence: Synthetic polypeptide

SEQ ID NO: 12939 - protein, 128 aa, Artificial Sequence; identical to SEQ ID NO: 8054
  Description of Artificial Sequence: Synthetic polypeptide

SEQ ID NO: 12940 - protein, 113 aa, Artificial Sequence
  Description of Artificial Sequence: Synthetic polypeptide
DVLMTQIPVSLPVSLGDQASISCRSSQIIVHNNGNTYLEWYLQKPGQSPQLLIYKVSNRFSGVPDRFSGSGSGTDFTLKISRVEAEDLGVYYCFQGSHVPFTFGSGTKLEIKR

SEQ ID NO: 12941 - protein, 219 aa, Artificial Sequence
  Description of Artificial Sequence: Synthetic polypeptide
  humanized immunoglobulin
DIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12942 - protein, 236 aa, Artificial Sequence
  Description of Artificial Sequence: Synthetic polypeptide
MDMRVPAQLLGLLLLWFPGARCDIQMTQSPSSLSASVGDRVTITCRASQDIRRDLGWYQQKPGKAPKRLIYAASRLQSGVPSRFSGSGSGTEFTLTISSLQPEDFATYYCLQHNNYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12943 - protein, 112 aa, Mus musculus
DVVMTQTPLSLPVSLGDQASISCRSSQSLVHSNGNTYLEWYLQKPGQSPKLLIYKVSNRFSGVPDRFSGSGSGTDFTLKISRVEAEDLGVYYCFQGTHVPYTFGGGTKLEIK

SEQ ID NO: 12944 - protein, 100 aa, Homo sapiens; identical to SEQ ID NO: 4146

SEQ ID NO: 12945 - protein, 109 aa, Homo sapiens
DIQMTQSPSSLSASVGDRVTITCRASKTISKYLAWYQQKPGKAPKLLIYYSGSTLESGVPSRFSGSGSGTDFTLTISSLQPEDFATYYCQQHNEYPLTFGQGTKVEIKR

SEQ ID NO: 12946 - protein, 114 aa, Artificial Sequence
  Description of Artificial Sequence: Synthetic polypeptide
  Synthetic kappa light chain consensus sequence
  MOD_RES (13)..(13): Any amino acid
  MOD_RES (29)..(34): Any amino acid
  MOD_RES (36)..(38): Any amino acid
  MOD_RES (56)..(56): Any amino acid
  MOD_RES (98)..(98): Any amino acid
  MOD_RES (100)..(100): Any amino acid
  MOD_RES (102)..(103): Any amino acid
DIQMTQSPSSLSXSVGDRVTITCRASQSXXXXXXIXXXLAWYQQKPGKAPKLLIYXASTLQSGVPSRFSGSGSGTDFTLTISSLQPEDFATYYCQQYXSXPXXTFGQGTKVEIK

SEQ ID NO: 12947 - protein, 105 aa, Artificial Sequence [sequence omitted]

SEQ ID NO: 12948 - protein, 330 aa, Artificial Sequence; identical to SEQ ID NO: 10911
  Description of Artificial Sequence: Synthetic polypeptide

SEQ ID NO: 12949 - protein, 113 aa, Artificial Sequence
  Description of Artificial Sequence: Synthetic polypeptide
  Synthetic kappa light chain protein sequence
DIVMTQSPDSLAVSLGERATINCKSSQSVLFSSNNKNYLAWYQQKPGQPPKLLIYWASTRESGVPDRFSGSGSGTDFTLTISSLQAEDVAVYYCQQYFSPPWTFGQGTKVEIK

SEQ ID NO: 12950 - protein, 113 aa, Artificial Sequence
  Description of Artificial Sequence: Synthetic polypeptide
  Synthetic kappa light chain protein sequence
DIVMTQSPDSLAVSLGERATINCKSSQSIFYSSTNKNYLAWYQKKPGQPPKLLIYWASTRESGVPDRFSGSGSGTDFTLTISSLQAEDVAVYYCQQYYSTPWTFGQGTKVEIK

SEQ ID NO: 12951 - protein, 107 aa, Artificial Sequence
  Description of Artificial Sequence: Synthetic polypeptide
  Synthetic kappa light chain protein sequence
DIQMTQSPSSLSASVGDRVTITCRASQGIRNDLGWFQQKPGKAPKRLIYAASSLQSGVPSRFSGSGSGTEFTLTISSLQPEDFATYYCLQHDSYPLTFGGGTKVEIK

SEQ ID NO: 12952 - protein, 107 aa, Artificial Sequence
  Description of Artificial Sequence: Synthetic polypeptide
  Synthetic kappa light chain protein sequence
DIQMTQSPSSLSASVGDRVTITCRASQGIRNDLGWYQQKPGKAPKRLIYVASSLQSGVPSRFSGSGSGTEFTLTISSLQPEDFATYYCLQHNSYPLTFGGGTKVEIK

SEQ ID NO: 12953 - protein, 107 aa, Artificial Sequence
  Description of Artificial Sequence: Synthetic polypeptide
  Synthetic kappa light chain protein sequence
DIQMTQSPSSVSASVGDRVTITCRASQGISSWLAWYQQKPGKAPNLLIYEASSLQSGVPSRFGGSGSGTDFTLTISSLQPEDFATYYCQQANGFPWTFGQGTKVEIK

SEQ ID NO: 12954 - protein, 107 aa, Artificial Sequence
  Description of Artificial Sequence: Synthetic polypeptide
  Synthetic kappa light chain protein sequence
DIQMTQSPSSLSVSVGDRVTITCRASQGISSYLAWYQQKPGKVPKLLIYVASTLQSGVPSRFSGSGSGTDFTLTISSLQPEDVATYYCQNYNSDPLTFGGGTKVEIK

SEQ ID NO: 12955 - protein, 107 aa, Artificial Sequence
  Description of Artificial Sequence: Synthetic polypeptide
  Synthetic kappa light chain protein sequence
DIQMTQSPSSLSASVGDRVTITCRASQSINSDLNWYQQKPGKVPKLLIYVASSLQNGVPSRFSGSGSGTDFTLTISSLQPEDFATYYCQRSYSTPPTFGPGTKVDIK

SEQ ID NO: 12956 - protein, 107 aa, Artificial Sequence
  Description of Artificial Sequence: Synthetic polypeptide
  Synthetic kappa light chain protein sequence
DIQMTQSPSSLSASVGDRVTITCQASDQISNYLNWYQQKPGTAPKLLIYGASDLETGVPSRFSGSGSGTDFTFAISSLQPEDIATYYCQQYDNLPYNFGQGTKLEIK

SEQ ID NO: 12957 - protein, 108 aa, Artificial Sequence
  Description of Artificial Sequence: Synthetic polypeptide
  Synthetic kappa light chain protein sequence
EIVMTQSPATLSVSPGERATLSCRASQSVDSNLAWYRQKPGQAPRLLIYGASTRATGIPARFSGSGSGTEFTLTISSLQSEDFAVYYCQQYINWPPITFGQGTRLEIK

SEQ ID NO: 12958 - protein, 108 aa, Artificial Sequence
  Description of Artificial Sequence: Synthetic polypeptide
  Synthetic kappa light chain protein sequence
EIVMTQSPATLSVSPGERATLSCRASQSVSSNLAWYQQKPGQAPRLLMYGASTRATGIPARFSGSGSGTEFTLTISSLQSEDFAVYYCQQYNNWPPITFGQGTRLEIK

SEQ ID NO: 12959 - protein, 107 aa, Artificial Sequence
  Description of Artificial Sequence: Synthetic polypeptide
DIQLTQSPSSLSASVGDRVTMTCSASSRVSYIHWYQQKPGKAPKRWIYGTSTLASGVPARFSGSGSGTDFTFTISSLQPEDIATYYCQQWSYNPPTFGQGTKVEIKR

SEQ ID NO: 12960 - protein, 108 aa, Artificial Sequence
  Description of Artificial Sequence: Synthetic polypeptide
DIQLTQSPSSLSASVGDRVTITCKASQEVGTAVAWYQQKPGKAPKLLIYWASTRHTGVPSRFSGSGSGTDFTFTISSLQPEDIATYFCQQYSNYPLTFGQGTKVEIKR

SEQ ID NO: 12961 - protein, 132 aa, Mus musculus
MKLPVRLLVLMFWIPASSSDVLMTQTPLSLPVSLGDQASISCRSSQSIVHSNVNTYLEWYLQKPGQSPKLLIYKVSNRFSGVPDRFSGSGSGTDFTLRISRVEAEDLGIYYCFQGSHVPPTFGGGTKLEIKR

SEQ ID NO: 12962 - protein, 108 aa, Artificial Sequence
  Description of Artificial Sequence: Synthetic polypeptide
  L2G7 light chain
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKR

SEQ ID NO: 12963 - protein, 107 aa, Homo sapiens [sequence omitted]

SEQ ID NO: 12964 - protein, 108 aa, Artificial Sequence
  Description of Artificial Sequence: Synthetic polypeptide
  HuL2G7 light chain variable region
DIVMTQSPSSLSASVGDRVTITCKASENVVTYVSWYQQKPGKAPKLLIYGASNRYTGVPDRFSGSGSGTDFTLTISSLQPEDFATYYCGQGYSYPYTFGQGTKLEIKR

SEQ ID NO: 12965 - protein, 108 aa, Artificial Sequence
  Description of Artificial Sequence: Synthetic polypeptide
  BAC01726 light chain variable region
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKR

SEQ ID NO: 12966 - protein, 240 aa, Artificial Sequence [sequence omitted]

SEQ ID NO: 12967 - protein, 240 aa, Artificial Sequence
  Description of Artificial Sequence: Synthetic polypeptide
  polypeptide consisting of light chain of huAbF46-H4-A1 and human kappa constant region
  1-20: signal peptide
MDSQAQVLMLLLLSVSGTCGDIQMTQSPSSLSASVGDRVTITCKSSQSLLASGNQNNYLAWHQQKPGKAPKMLIIWASTRVSGVPSRFSGSGSGTDFTLTISSLQPEDFATYYCQQSYSRPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12968 - protein, 242 aa, Artificial Sequence
  Description of Artificial Sequence: Synthetic polypeptide
  recombinant immunoglobulin
MKKNIAFLLASMFVFSIATNAYADIQMTQSPSSLSASVGDRVTITCRSSQSLVHGIGETYLHWYQQKPGKAPKLLIYKVSNRFSGVPSRFSGSGSGTDFTLTISSLQPEDFATYYCSQSTHVPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 12969 - protein, 119 aa, Artificial Sequence
  Description of Artificial Sequence: Synthetic polypeptide
  DP-h10, 13 heavy chain protein
EVQLVQSGAEVKKPGATVKISCKVSGFSLTNYGVHWIRQPPGKGLEWIGVIWSGGNTDYNTPFTSRFTISRDNAKNSLYLQMNSLRAEDTAVYYCARALTYYDDEFAYWGPGTLVTVSA

SEQ ID NO: 12970 - protein, 107 aa, Artificial Sequence
  Description of Artificial Sequence: Synthetic polypeptide
EIVLTQSPATLSLSPGERATLSCRASQSIGTNIHWYQQKPGKAPKLLIYYASESISGIPDRFSGSGSGTDFTLTISRLEPEDFAVYYCQQNNNWPTTFGQGTKLELK

SEQ ID NO: 12971 - protein, 88 aa, Homo sapiens; identical to SEQ ID NO: 7775

SEQ ID NO: 12972 - protein, 88 aa, Homo sapiens; identical to SEQ ID NO: 7776

SEQ ID NO: 12973 - protein, 88 aa, Homo sapiens; identical to SEQ ID NO: 7777

SEQ ID NO: 12974 - protein, 220 aa, Artificial Sequence; identical to SEQ ID NO: 7840
  Description of Artificial Sequence: Synthetic polypeptide

SEQ ID NO: 12975 - protein, 126 aa, Artificial Sequence
  Description of Artificial Sequence: Synthetic polypeptide
  Variable chain of single chain antibody
EVQLVQSGAEVKKPGSSVKVSCKASGGTFSSYAIGWVRQAPGQGLEWMGGIIPIFGIANYAQKFQGRVTITADESTSSAYMELSSLRSEDTAVYYCAREEGPYCSSTSCYGAFDIWGQGTLVTVSS

SEQ ID NO: 12976 - protein, 126 aa, Artificial Sequence
  Description of Artificial Sequence: Synthetic polypeptide
  Variable chain of single chain antibody
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREEGPYCSSTSCYAAFDIWGQGTLVTVSS

SEQ ID NO: 12977 - protein, 114 aa, Mus musculus
DVLMTQTPLSLPVSLGDHASISCRSSQSIVQSNGDTYLEWYLQKPGQSPKLLIYRISNRFSGVPDRFSGSGSGTDFTLKISRVEAEDLGVYYCFQGSHVPYTFGGGTKLEIKRA

SEQ ID NO: 12978 - protein, 109 aa, Mus musculus
NIVLTQSPKSMSMSIGERVTLSCKASENVGTYVSWYQQKAEQSPKLLIYGASNRHTGVPDRFTGSGSSTDFTLTISSVQAEDLADYHCGQSYSDPLTFGAGTKLELKRA

SEQ ID NO: 12979 - protein, 114 aa, Artificial Sequence
  Description of Artificial Sequence: Synthetic polypeptide
  Chimeric variable heavy chain comprising sequences from mus musculus and homo sapiens
DVLMTQTPLSLPVSLGDHASISCRSSQSIVQSNGDTYLEWYLQKPGQSPKLLIYRISNRFSGVPDRFSGSGSGTDFTLKISRVEAEDLGVYYCFQGSHVPYTFGGGTKLEIKRT

SEQ ID NO: 12980 - protein, 114 aa, Homo sapiens
DIVMTQSPLSLPVTPGEPASISCRSSQSIVQSNGDTYLEWYLQKPGQSPQLLIYRVSNRFSGVPDRFSGSGSGTDFTLKISRVEAEDVGVYYCFQGSHVPYTFGQGTKLEIKRT

SEQ ID NO: 12981 - protein, 114 aa, Mus musculus
DVLMTQSPLSLPVSLGDHASISCRSSQSIVQSNGDTYLEWYLQKPGQSPKLLIYRVSNRFSGVPDRFSGSGSGTDFTLKISRVEAEDLGVYYCFQGSHVPYTFGGGTKLEIKRA

SEQ ID NO: 12982 - protein, 114 aa, Mus musculus
DVLMTQTPLSLPVSLGDQASISCRSSQTIVHSNGNTYLEWYLQKPGQSPKLLIYKVSNRFSGVPDRFSGSGSGTDFTLKISRVEAEDLGIYYCFQGSHVPYTFGGGTKLEIKRA

SEQ ID NO: 12983 - protein, 114 aa, Mus musculus
DVLMTQTPLSLPVSLGDQASISCRSSQTIVHSNGNTYLEWYLQKPGQSPKLLIYRVSYRFSGVPDRFSGSGSGTDFTLKISRLEAEDLGIYYCFQGSHVPYTFGGGTKLEIKRA

SEQ ID NO: 12984 - protein, 111 aa, Artificial Sequence
  Description of Artificial Sequence: Synthetic polypeptide
  LC1: Light chain variable domain of anti-alpha2-integrin mAb with humanizing mutations
NIVLTQSPSSLAVSVGQRATISCRASESVESYGNSFIYWYQQKPGKAPKLLIYLASNLASGVPARFSGSGSRTDFTLTIDPVQADDAATYYCQQNNEDPYTFGGGTKLEIK

SEQ ID NO: 12985 - protein, 111 aa, Artificial Sequence
  Description of Artificial Sequence: Synthetic polypeptide
  LC2: Light chain variable domain of anti-alpha2-integrin mAb with humanizing mutations
NIVLTQSPSSLAVSVGQRATISCRASESVESYGQSFIYWYQQKPGKAPKLLIYLASNLASGVPARFSGSGSRTDFTLTIDPVQADDAATYYCQQNNEDPYTFGGGTKLEIK

SEQ ID NO: 12986 - protein, 111 aa, Artificial Sequence
  Description of Artificial Sequence: Synthetic polypeptide
  LC3: Light chain variable domain of anti-alpha2-integrin mAb with humanizing and stabilizing mutations
NIVLTQSPSSLSVSVGQRATISCRASESVESYGNSFIYWYQQKPGQAPKLLIYLASNLASGVPARFSGSGSRTDFTLTIDPVQAEDAATYYCQQNNEDPYTFGGGTKLEIK

SEQ ID NO: 12987 - protein, 111 aa, Artificial Sequence
  Description of Artificial Sequence: Synthetic polypeptide
  LC4: Light chain variable domain of anti-alpha2-integrin mAb with humanizing and stabilizing mutations
NIVLTQSPSSLSVSVGQRATISCRASESVESYGQSFIYWYQQKPGQAPKLLIYLASNLASGVPARFSGSGSRTDFTLTIDPVQAEDAATYYCQQNNEDPYTFGGGTKLEIK

SEQ ID NO: 12988 - protein, 111 aa, Artificial Sequence
  Description of Artificial Sequence: Synthetic polypeptide
  LC5: Light chain variable domain of anti-alpha2-integrin mAb with grafted mutations
NIVLTQSPASLAVSPGQRATITCRASESVESYGNSFIYWYQQKPGQPPKLLIYLASNLASGVPARFSGSGSRTDFTLTINPVEADDTANYYCQQNNEDPYTFGGGTKLEIK

SEQ ID NO: 12989 - protein, 111 aa, Artificial Sequence
  Description of Artificial Sequence: Synthetic polypeptide
  Light chain variable domain of anti-alpha2-integrin mAb
NIVLTQSPASLAVSLGQRATISCRASESVESYGNSFIYWYQQKPGQAPKLLIYLASNLASGVPARFSGSGSRTDFTLTIDPVEADDAATYYCQQNNEDPYTFGGGTKLEIK

SEQ ID NO: 12990 - protein, 108 aa, Artificial Sequence
  Description of Artificial Sequence: Synthetic polypeptide
DIQMTQSPSSLSASVGDRVTITCQASQDIIKYLNWYQQTPGKAPKLLIYEASNLQAGVPSRFSGSGSGTDYTFTISSLQPEDIATYYCQQYQSLPYTFGQGTKLQITR

SEQ ID NO: 12991 - protein, 113 aa, Artificial Sequence
  Description of Artificial Sequence: Synthetic polypeptide
DIQLTQSPSSLAVSAGENVTMSCKSSQSVLYSANHKNYLAWFQQKPGQSPKLLIYWASTRESGVPDRFTGSGSGTDFTLTISRVQVEDLAIYYCHQYLSSWTFGGGTKLEIKR

SEQ ID NO: 12992 - protein, 113 aa, Artificial Sequence
  Description of Artificial Sequence: Synthetic polypeptide
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKVQIKR

SEQ ID NO: 12993 - protein, 107 aa, Artificial Sequence
  Description of Artificial Sequence: Synthetic polypeptide
DIQLTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIK

SEQ ID NO: 12994 - protein, 108 aa, Artificial Sequence
  Description of Artificial Sequence: Synthetic polypeptide
  synthetic construct
  MOD_RES (54)..(54): Any naturally occurring amino acid
  MOD_RES (56)..(56): Any naturally occurring amino acid
EIVLTQSPGTLSLSPGERATLSCSVSSSISSTNLHWYQQKPGQAPRLLIYGTSXLXSGIPDRFSGSGSGTDFTLTISRLEPEDFAVYYCQQWSSYPYSFGQGTKLEIK

SEQ ID NO: 12995 - protein, 108 aa, Artificial Sequence
  Description of Artificial Sequence: Synthetic polypeptide
  synthetic construct
  MOD_RES (30)..(30): Any naturally occurring amino acid
  MOD_RES (90)..(91): Any naturally occurring amino acid
  MOD_RES (93)..(93): Any naturally occurring amino acid
DIQMTQSPSSLSASVGDRVTITCSVSSSVXSIYLHWYQQKPGKAPKLLIYSTSNLASGVPSRFSGSGSGTDFTLTISSLQPEDFATYYCXXYXGYPLTFGGGTKVEIK

SEQ ID NO: 12996 - protein, 108 aa, Homo sapiens; identical to SEQ ID NO: 4535

SEQ ID NO: 12997 - protein, 108 aa, Homo sapiens
DIQMTQSPSSLSASVGDRVTITCRASQDVSTAVAWYQQKPGKAPKLLIYSASFLYSGVPSRFSGSGSGTDFTLTISSLQPEDFATYYCQQSKTTPPTFGQGTKVEIKR

SEQ ID NO: 12998 - protein, 108 aa, Homo sapiens
DIQMTQSPSSLSASVGDRVTITCRASQDVSTAVAWYQQKPGKAPKLLIYSASFLYSGVPSRFSGSGSGTDFTLTISSLQPEDFATYYCQQSYMSPLTFGQGTKVEIKR

SEQ ID NO: 12999 - protein, 128 aa, Artificial Sequence
  Description of Artificial Sequence: Synthetic polypeptide
  6D10-1-1 VL amino acids-signal plus
MMSSAQFLGLLLLCFQGTRCDIQMTQITSSLSASLGDRVTISCSASQDISNYLNWYQQKPDGTVKLLIYYTSSLHSEVPSRFSGSGSGTDYSLTISNLEPEDIATYYCQQYINLPLTFGAGTKLELKR

SEQ ID NO: 13000 - protein, 132 aa, Artificial Sequence
  Description of Artificial Sequence: Synthetic polypeptide
  10D5-2-3 VL amino acids-signal plus
MEKDTLLLWVLLLWVPGSTGDIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKR

SEQ ID NO: 13001 - protein, 129 aa, Artificial Sequence
  Description of Artificial Sequence: Synthetic polypeptide
  3B7-3-3 VL amino acids-signal plus
MDFQVQIFSFLLMSASVIMSRGQIVLTQSPALMSAFPGEKVTMTCSASSSVSYMYWYQQKPRSSPKPWIYLTSNLASGVPTRFSGSGSGTSYSLTISSMEAEDAATYFCQQWSSNPRTFGGGTKLEIKR

SEQ ID NO: 13002 - protein, 108 aa, Artificial Sequence
  Description of Artificial Sequence: Synthetic polypeptide
  6D10-1-1 VL amino acids-signal minus
DIQMTQITSSLSASLGDRVTISCSASQDISNYLNWYQQKPDGTVKLLIYYTSSLHSEVPSRFSGSGSGTDYSLTISNLEPEDIATYYCQQYINLPLTFGAGTKLELKR

SEQ ID NO: 13003 - protein, 112 aa, Artificial Sequence
  Description of Artificial Sequence: Synthetic polypeptide
  10D5-2-3 VL amino acids-signal minus
DIVLTQSPASLAVSLGQRATISCRASESVDNYGISFMNWFQQKPGQPPKLLIYAASNQGSGVPARFSGSGSGTDFSLNIHPMEEDDTAMYFCQQSKEVPWTFGGGTKLEIKR

SEQ ID NO: 13004 - protein, 107 aa, Artificial Sequence
  Description of Artificial Sequence: Synthetic polypeptide
  3B7-3-3 VL amino acids-signal minus
QIVLTQSPALMSAFPGEKVTMTCSASSSVSYMYWYQQKPRSSPKPWIYLTSNLASGVPTRFSGSGSGTSYSLTISSMEAEDAATYFCQQWSSNPRTFGGGTKLEIKR

SEQ ID NO: 13005 - protein, 111 aa, Artificial Sequence
  Description of Artificial Sequence: Synthetic polypeptide
  LV0 amino acids
DIVMTQSPDSLAVSLGERATINCRASESVDNYGISFMNWYQQKPGQPPKLLIYAASNQGSGVPDRFSGSGSGTDFTLTISSLQAEDVAVYYCQQSKEVPWTFGQGTKLEIK

SEQ ID NO: 13006 - protein, 119 aa, Artificial Sequence
  Description of Artificial Sequence: Synthetic polypeptide
  HV4b amino acids
EVQLVESGGGLVQPGGSLRLSCAASGFTFSNYWMNWVRQAPGKGLEWVAHIRLKSDNYATHYAESVRGRFTISRDDSKNSLYLQMNSLKTEDTAIYYCTGGSNYVFAFWGQGTLVTVSS

SEQ ID NO: 13007 - protein, 119 aa, Artificial Sequence
  Description of Artificial Sequence: Synthetic polypeptide
  HV9 amino acids
EVQLVESRGGLVQPGGSMRLSCAASGFTFSNYWMNWVRQAPGKGLEWVAHIRLKSDNYATHYAESVRGRFTISRDDSKSSVYLQMNSLKTEDTGIYYCTGGSNYVFAFWGQGTLVTVSS

SEQ ID NO: 13008 - protein, 111 aa, Artificial Sequence
  Description of Artificial Sequence: Synthetic polypeptide
  LV2 amino acids
DIVMTQSPDSLAVSLGERATINCRASESVDNYGISFMNWFQQKPGQPPKLLIYAASNQGSGVPDRFSGSGSGTDFTLTISSLQAEDVAVYFCQQSKEVPWTFGQGTKLEIK

SEQ ID NO: 13009 - protein, 111 aa, Artificial Sequence
  Description of Artificial Sequence: Synthetic polypeptide
  LV3 amino acids
DIVMTQSPDSLAVSLGERATINCRASESVDNYGISFMNWFQQKPGQPPKLLIYAASNQGSGVPDRFSGSGSGTDFTLTISPLQAEDVAVYFCQQSKEVPWTFGQGTKLEIK

SEQ ID NO: 13010 - protein, 111 aa, Artificial Sequence
  Description of Artificial Sequence: Synthetic polypeptide
  LV4 amino acids
DIVLTQSPDSLAVSLGERATINCRASESVDNYGISFMNWYQQKPGQPPKLLIYAASNQGSGVPDRFSGSGSGTDFTLTISPMQAEDVAMYYCQQSKEVPWTFGQGTKLEIK

SEQ ID NO: 13011 - protein, 111 aa, Artificial Sequence
  Description of Artificial Sequence: Synthetic polypeptide
  LV6 amino acids
DIVLTQSPDSLAVSLGERATINCRASESVDNYGISFMNWFQQKPGQPPKLLIYAASNQGSGVPDRFSGSGSGTDFTLTISPMQAEDVAMYFCQQSKEVPWTFGQGTKLEIK

SEQ ID NO: 13012 - protein, 107 aa, Artificial Sequence
  Description of Artificial Sequence: Synthetic polypeptide
DIVMTQSHKFMSTSVGDRVSITCKASQDVSTDVAWYQQKPGQSPKLLIYSASYRYTGVPDRFTGSGSGTDFTFTISSVQAEDLAVYYCQQHYSTPFTFGSGTKLEIK

SEQ ID NO: 13013 - protein, 95 aa, Artificial Sequence
  Description of Artificial Sequence: Synthetic polypeptide
DIQMTQSPSSLSASVGDRVTITCQASQDISNYLNWYQQKPGKAPKLLIYDASNLETGVPSRFSGSGSGTDFTFTISSLQPEDIATYYCQQYDNLP

SEQ ID NO: 13014 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 13015 - protein, 107 aa, Artificial Sequence
  Description of Artificial Sequence: Synthetic polypeptide
DIQMTQSPSSLSASVGDRVTITCKASQDVSTDVAWYQQKPGKAPKLLIYSASYRYTGVPSRFSGSGSGTDFTFTISSLQPEDIATYYCQQHYSTPFTFGQGTKLEIK

SEQ ID NO: 13016 - protein, 107 aa, Artificial Sequence
  Description of Artificial Sequence: Synthetic polypeptide
DIQMTQSPSSLSASVGDRVTITCKASQDVSTDVAWYQQKPGKAPKLLIYSASYRYTGVPSRFSGSGSGTDFTLTISSLQPEDIATYYCQQHYSTPFTFGQGTKLEIK

SEQ ID NO: 13017 - protein, 107 aa, Artificial Sequence
  Description of Artificial Sequence: Synthetic polypeptide
DIQMTQSPSSLSASVGDRVTITCKASQDVSTDVAWYQQKPGKSPKLLIYSASYRYTGVPSRFSGSGSGTDFTLTISSLQPEDIATYYCQQHYSTPFTFGQGTKLEIK

SEQ ID NO: 13018 - protein, 107 aa, Artificial Sequence
  Description of Artificial Sequence: Synthetic polypeptide
DIVMTQSPSSLSASVGDRVTITCKASQDVSTDVAWYQQKPGKSPKLLIYSASYRYTGVPSRFSGSGSGTDFTLTISSLQPEDIATYYCQQHYSTPFTFGQGTKLEIK

SEQ ID NO: 13019 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 13020 - protein, 107 aa, Artificial Sequence
  Description of Artificial Sequence: Synthetic polypeptide
DIQMTQSPSSLSASVGDRVTITCKASQSVSNDVAWYQQKPGKAPKLLIYYASNRYTGVPSRFSGSGSGTDFTFTISSLQPEDIATYYCQQDYSSPYTFGGGTKVEIK

SEQ ID NO: 13021 - protein, 107 aa, Artificial Sequence
  Description of Artificial Sequence: Synthetic polypeptide
DIQMTQSPSSLSASVGDRVTITCKASQSVSNDVAWYQQKPGKSPKLLIYYASNRYTGVPSRFSGSGSGTDFTFTISSLQPEDIATYFCQQDYSSPYTFGGGTKVEIK

SEQ ID NO: 13022 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPPTFGGGTKVEIK

SEQ ID NO: 13023 - protein, 107 aa, Artificial Sequence
  Description of Artificial Sequence: Synthetic polypeptide
EIVMTQSPATLSVSPGERATLSCKASQSVSNDVAWYQQKPGQAPRLLIYYASNRYTGIPARFSGSGSGTEFTLTISSLQSEDFAVYYCQQDYSSPYTFGGGTKVEIK

SEQ ID NO: 13024 - protein, 107 aa, Artificial Sequence
  Description of Artificial Sequence: Synthetic polypeptide
EIVMTQSPATLSVSPGERATLSCKASQSVSNDVAWYQQKPGQSPRLLIYYASNRYTGVPARFSGSGSGTEFTLTISSLQSEDFAVYFCQQDYSSPYTFGGGTKVEIK

SEQ ID NO: 13025 - protein, 107 aa, Artificial Sequence
  Description of Artificial Sequence: Synthetic polypeptide
SIVMTQSPKILLVSAGDRVTITCKASQSVSNDVAWYQQKPGQSPKLLIYYASNRYTGVPDRFTGSGYGTDFTFTISTVQAEDLAVYFCQQDYSSPYTFGGGTKLEIK

SEQ ID NO: 13026 - protein, 108 aa, Artificial Sequence
  Description of Artificial Sequence: Synthetic polypeptide
EIVLTQSPALMAASPGEKVTITCSVSSSINSINLHWYRQKSETSPKPWIYGTSNLASGVPVRFSGSGSGTSYSLTISSMEAEDAATYYCQQWSSYPLTFGAGTKLELK

SEQ ID NO: 13027 - protein, 111 aa, Artificial Sequence
  Description of Artificial Sequence: Synthetic polypeptide
  wt 5c8 light chain variable region polypeptide
DIVLTQSPATLSVSPGERATISCRASQRVSSSTYSYMHWYQQKPGQPPKLLIKYASNLESGVPARFSGSGSGTDFTLTISSVEPEDFATYYCQHSWEIPPTFGGGTKLEIK

SEQ ID NO: 13028 - protein, 111 aa, Artificial Sequence
  Description of Artificial Sequence: Synthetic polypeptide
  MOD_RES (24)..(24): Any amino acid
  MOD_RES (26)..(28): Any amino acid
  MOD_RES (30)..(36): Any amino acid
  MOD_RES (38)..(38): Any amino acid
  MOD_RES (54)..(54): Any amino acid
  MOD_RES (57)..(60): Any amino acid
  MOD_RES (93)..(93): Any amino acid
  MOD_RES (95)..(98): Any amino acid
  MOD_RES (100)..(101): Any amino acid
DIVLTQSPATLSVSPGERATISCXAXXXVXXXXXXXMXWYQQKPGQPPKLLIKXASXXXXGVPARFSGSGSGTDFTLTISSVEPEDFATYYCXHXXXXPXXFGGGTKLEIK

SEQ ID NO: 13029 - protein, 111 aa, Artificial Sequence
  Description of Artificial Sequence: Synthetic polypeptide
DIVLTQSPATLSVSPGERATISCRADQRVSSSTYSYMHWYQQKPGQPPKLLIKYASNLESGVPARFSGSGSGTDFTLTISSVEPEDFATYYCQHSWEIPPTFGGGTKLEIK

SEQ ID NO: 13030 - protein, 111 aa, Artificial Sequence
  Description of Artificial Sequence: Synthetic polypeptide
DIVLTQSPATLSVSPGERATISCRASERVSSSTYSYMHWYQQKPGQPPKLLIKYASNLESGVPARFSGSGSGTDFTLTISSVEPEDFATYYCQHSWEIPPTFGGGTKLEIK

SEQ ID NO: 13031 - protein, 111 aa, Artificial Sequence
  Description of Artificial Sequence: Synthetic polypeptide
DIVLTQSPATLSVSPGERATISCRADERVSSSTYSYMHWYQQKPGQPPKLLIKYASNLESGVPARFSGSGSGTDFTLTISSVEPEDFATYYCQHSWEIPPTFGGGTKLEIK

SEQ ID NO: 13032 - protein, 111 aa, Artificial Sequence
  Description of Artificial Sequence: Synthetic polypeptide
DIVLTQSPATLSVSPGERATISCRASQRVSSSWYSYMHWYQQKPGQPPKLLIKYASNLESGVPARFSGSGSGTDFTLTISSVEPEDFATYYCQHSWEIPPTFGGGTKLEIK

SEQ ID NO: 13033 - protein, 111 aa, Artificial Sequence
  Description of Artificial Sequence: Synthetic polypeptide
DIVLTQSPATLSVSPGERATISCRADERVSSSWYSYMHWYQQKPGQPPKLLIKYASNLESGVPARFSGSGSGTDFTLTISSVEPEDFATYYCQHSWEIPPTFGGGTKLEIK

SEQ ID NO: 13034 - protein, 124 aa, Artificial Sequence
  Description of Artificial Sequence: Synthetic polypeptide
  Anti-CD19 VH
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 13035 - protein, 111 aa, Rattus sp.
QAVVTQANSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLR

SEQ ID NO: 13036 - protein, 110 aa, Artificial Sequence
  Description of Artificial Sequence: Synthetic polypeptide
DFMLTQPHSVSESPGKTVIISCTLSSGNIENNYVHWYQQRPGRAPTTVIFDDDKRPDGVPDRFSGSIDRSSNSASLTISGLQTEDEADYYCHSYVSSFNVFGGGTKLTVL

SEQ ID NO: 13037 - protein, 105 aa, Artificial Sequence
  Description of Artificial Sequence: Synthetic polypeptide
  Anti-CD3 VL
IQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 13038 - protein, 107 aa, mus sp.
DIQLTQSPAIMSASPGEKVTMTCSASSRVSYIHWYQQKSGTSPKRWIYGTSTLASGVPARFSGSGSGTSYSLTISSMEAEDAATYYCQQWSYNPPTFGAGTKLELKR

SEQ ID NO: 13039 - protein, 121 aa, mus sp.
EVRLVESGGGLVQGPGSLRLSCAASGFALTDYYMSWVRQSPGKTLEWLGFIANKANGHTTDYSPSVKGRFTISRDNSQTILYLQMNTLRTEDSATYYCARDMGIRWNFDVWGQGTTVTVSS

SEQ ID NO: 13040 - protein, 107 aa, Artificial Sequence
  Description of Artificial Sequence: Synthetic polypeptide
DIQLTQSPSSLSASVGDRVTITCQASQDIIKYLNWYQQKPGKAPKLLIYEASNLQAGVPSRFSGSGSGTDFTFTISSLQPEDIATYYCQQYQSLPYTFGQGTKVEIK

SEQ ID NO: 13041 - protein, 114 aa, Artificial Sequence
  Description of Artificial Sequence: Synthetic polypeptide
  Synthetic (light chain variable region of anti-c-Met antibody)
DILMTQSPSSLTVSAGEKVTMSCKSSQSLLASGNQNNYLAWHQQKPGRSPKMLIIWASTRVSGVPDRFIGSGSGTDFTLTINSVQAEDLAVYYCQQSYSAPLTFGAGTKLELKR

SEQ ID NO: 13042 - protein, 109 aa, Artificial Sequence
  Description of Artificial Sequence: Synthetic polypeptide
  light chain variable region of monoclonal antibody AbF24
DIVMSQSPSSLAVSVGEKITMSCKSSQSLLYSSNQKNYLAWYQQKPGQSPKLLIYWASTRKSGVPDRFTGSGSGTDFTLTISSVKAEDLAVYYCQQYYDYPFTFGSGTK

SEQ ID NO: 13043 - protein, 109 aa, Artificial Sequence
  Description of Artificial Sequence: Synthetic polypeptide
  light chain variable region of monoclonal antibody Stan34
DIVMTQSPSSLSVSVGEKVIMSCKSSQSLFNSGHQKNYLAWYQQKPGQPPKLLIYGASTRESGVPDRFTGSGSGTEFTLTIGSVQAEDLAVYYCQNDHTYPLTFGAGTK

SEQ ID NO: 13044 - protein, 114 aa, Artificial Sequence; identical to SEQ ID NO: 9375
  Description of Artificial Sequence: Synthetic polypeptide

SEQ ID NO: 13045 - protein, 114 aa, Artificial Sequence
  Description of Artificial Sequence: Synthetic polypeptide
  Synthetic light chain variable region
DIQMTQSPSSLSASVGDRVTITCKSSQSLLASGNQNNYLAWHQQKPGKAPKMLIIWASTRVSGVPSRFSGSGSGTDFTLTISSLQPEDFATYYCQQSYSRPYTFGQGTKVEIKR

SEQ ID NO: 13046 - protein, 114 aa, Artificial Sequence
  Description of Artificial Sequence: Synthetic polypeptide
  Synthetic heavy chain variable region of anti c-Met humanized antibody(huAbF46-H4)
DIQMTQSPSSLSASVGDRVTITCKSSQSLLASGNQNNYLAWHQQKPGKAPKMLIIWASTRVSGVPSRFSGSGSGTDFTLTISSLQPEDFATYYCAQSYSHPFSFGQGTKVEIKR

SEQ ID NO: 13047 - protein, 114 aa, Artificial Sequence
  Description of Artificial Sequence: Synthetic polypeptide
  Synthetic heavy chain variable region of anti c-Met humanized antibody(huAbF46-H4)
DIQMTQSPSSLSASVGDRVTITCKSSQSLLASGNQNNYLAWHQQKPGKAPKMLIIWASTRVSGVPSRFSGSGSGTDFTLTISSLQPEDFATYYCQQSYSRPFTFGQGTKVEIKR

SEQ ID NO: 13048 - protein, 114 aa, Artificial Sequence
  Description of Artificial Sequence: Synthetic polypeptide
  Synthetic amino acid sequence of light chain variable  region of antibody L3-11Y
DIQMTQSPSSLSASVGDRVTITCKSSQSLLAWGNQNNYLAWYQQKPGKAPKMLIIWASTRVSGVPSRFSGSGSGTDFTLTISSLQPEDFATYYCQQSYSRPYTFGQGTKVEIKR

SEQ ID NO: 13049 - protein, 114 aa, Artificial Sequence
  Description of Artificial Sequence: Synthetic polypeptide
  Synthetic light chain variable region of anti c-Met antibody
DIQMTQSPSSLSASVGDRVTITCKSSQSLLASGNQNNYLAWYQQKPGKAPKMLIIWASTRVSGVPSRFSGSGSGTDFTLTISSLQPEDFATYYCQQSYSRPYTFGQGTKVEIKR

SEQ ID NO: 13050 - protein, 114 aa, Artificial Sequence
  Description of Artificial Sequence: Synthetic polypeptide
  light chain variable region of AbF46
DIVMTQSPDSLAVSLGERATINCKSSQSLLASGNQNNYLAWHQQKPGQPPKMLIIWASTRVSGVPDRFSGSGSGTDFTLTISSLQAEDVAVYYCQQSYSAPLTFGGGTKVEIKR

SEQ ID NO: 13051 - protein, 114 aa, Artificial Sequence
  Description of Artificial Sequence: Synthetic polypeptide
  synthetic; light chain variable region of anti c-Met humanized antibody (huAbF46-H4)
DIQMTQSPSSLSASVGDRVTITCKSSQSLLASGNQNNYLAWHQQKPGKAPKMLIIWASTRVSGVPSRFSGSGSGTDFTLTISSLQPEDFATYYCQQSYSAPLTFGQGTKVEIKR

SEQ ID NO: 13052 - protein, 114 aa, Mus musculus
DIMMSQSPSSLTVSVGEKVTVSCKSSQSLLYTSSQKNYLAWYQQKPGQSPKLLIYWASTRESGVPDRFTGSGSGTDFTLTITSVKADDLAVYYCQQYYAYPWTFGGGTKLEIKR

SEQ ID NO: 13053 - protein, 119 aa, Artificial Sequence
  Description of Artificial Sequence: Synthetic polypeptide
  Sequence is synthesized
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCARYGSYVSPLDYWGQGTLVTVSS

SEQ ID NO: 13054 - protein, 108 aa, Artificial Sequence
  Description of Artificial Sequence: Synthetic polypeptide
  A12 light chain variable domain sequence
QSALTQDPAVSVALGQTVRITCRGDSLRNYYASWYQQKPGQAPVLVIYGKNNRPSGIPDRFSGSFSGNTASLTITGAQAEDEADYYCNSRDSSANQMFGGGTKVTVLG

SEQ ID NO: 13055 - protein, 108 aa, Artificial Sequence
  Description of Artificial Sequence: Synthetic polypeptide
  C2 light chain variable domain sequence
DIVMTQSPSSLSASIGDRVTITCRASHSISSYVNWYQKKPGKAPNLLIYAASYLPRGVPSRFSGSGLGTDFTLTISNLQPEDFATYYCQESYSTPYSFGQGTKVDIKR

SEQ ID NO: 13056 - protein, 108 aa, Artificial Sequence
  Description of Artificial Sequence: Synthetic polypeptide
EIVLTQSPSTLSASIGDRVTITCRASQGISSYLAWYQQKPGKAPKLLIYGASSLQSGVPSRFSGRGSGADFTLTISSLQPEDFATYYCQQLISYPLTFGGGTKVEIKR

SEQ ID NO: 13057 - protein, 111 aa, Artificial Sequence
  Description of Artificial Sequence: Synthetic polypeptide
  F11 light chain variable domain sequence
QSVLTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLFGGGTKLTVLG

SEQ ID NO: 13058 - protein, 111 aa, Artificial Sequence
  Description of Artificial Sequence: Synthetic polypeptide
  G1 light chain variable domain sequence
QSVLTQPPSASGTPGQRVTLFCSGSSSNIASNSVKWYQQPPQRAPKLLMFSDDQRPSGVPVRFSASKSGTSASLAISGLQSEDEADYYCAAWDDSLNAEVFGGGTKVTVLG

SEQ ID NO: 13059 - protein, 108 aa, Artificial Sequence
  Description of Artificial Sequence: Synthetic polypeptide
  H2 light chain variable domain sequence
SSELTQDPAVSVALGQTVRITCQGDSLRSYYTNWFQQKPGQAPLLVVYAKNKRPSGIPDRFSGSGSGDTASLTITGAQAEDEADYYCNSRDSSGNYLFAAGTKLTVLG

SEQ ID NO: 13060 - protein, 112 aa, Artificial Sequence
  Description of Artificial Sequence: Synthetic polypeptide
  H5 light chain variable domain sequence
QSVLTQPPSVSAAPGQKVTISCTGSSSNIGAGYDVHWYQQLPGTAPKLLIYGNSNRPSGVPDRFSGSKSGTSASLAISGLQSEDEADYYCAAWDDILNGEIFGGGTKVTVLG

SEQ ID NO: 13061 - protein, 107 aa, Homo sapiens; identical to SEQ ID NO: 8710

SEQ ID NO: 13062 - protein, 107 aa, Homo sapiens
DIQMTQSPSSVSASVGDRVTITCRASQGISSWLAWYQHKPGKAPKLLIYAASSLQSGVPSRFSGSGSGTDFTLTISSLQPEDFATYYCQEASSFTWTFGQGTKVEIK

SEQ ID NO: 13063 - protein, 106 aa, Homo sapiens
DIQMTQSPSSVSASVGDRVTITCRASQGISSWLAWYQHKPGKAPKLLIYAASSLQSGVPSRFSGSGSGTDFTLTISSLQPEDFATYYCQQANSFPTFGQGTRLEIK

SEQ ID NO: 13064 - protein, 108 aa, Homo sapiens
AIQLTQSPSSLSASVGDRVTITCRASQGISSALAWYQQKPGKAPKLLIYDASSLESGVPSRFSGSGSGTDFTLTISSLQPEDFATYYCQQFNSYPMYTFGQGTKLEIK

SEQ ID NO: 13065 - protein, 108 aa, Homo sapiens
AIQLTQSPSSLSASVGDRVTITCRASQGLSSALAWYRQKPGKAPKLLIYDASSLESGVPSRFSGSGSGTDFTLTISSLQPEDFATYYCQQFTSYPQITFGQGTRLEIK

SEQ ID NO: 13066 - protein, 107 aa, Homo sapiens
DIQMTQSPSSVSASVGDRVTITCRASQGISNWLAWFQHKPGKAPKLLIYAASSLLSGVPSRFSGSGSGTDFTLTISSLQPEDFATYYCQQANSFPITFGQGTRLEIK

SEQ ID NO: 13067 - protein, 107 aa, Homo sapiens
AIQLTQSPSSLSASVGDRVTITCRASQGISSALAWYQQKPGKAPNLLIYAASSLESGVPSRFSGSGSGTDFTLTISSLQPEDFATYYCQQFNSYPLTFGGGTKVEIK

SEQ ID NO: 13068 - protein, 107 aa, Homo sapiens
DIQMTQSPSSLSASVGDRVTITCRASQGISNWLAWYQQKPEKAPKSLIYAASSLQSGVPSRFSGSGSGTDFTLTISSLQPEDFATYYCHQYKSYPWTFGQGTKVEIK

SEQ ID NO: 13069 - protein, 108 aa, Homo sapiens
EIVLTQSPGTLSLSPGERATLSCRASQSVSSSYLAWYQQKPGQAPRLLIYGVFSRATGIPDRFSGSGSGTDFTLTISRLEPEDFAVYYCQQYGSSPYTFGQGTKLEIK

SEQ ID NO: 13070 - protein, 107 aa, Homo sapiens
DIQMTQSPSSLSASVGDRVTITCRASQGISSWLAWYQQKPEKAPKSLIYAASSLQSGVPSRFSGGGSGTDFTLTISSLQPEDFATYYCQQYNSFPPTFGQGTKVEIK

SEQ ID NO: 13071 - protein, 107 aa, Homo sapiens
DIQMTQSPSSVSASVGDRVTITCRASQGISSWLAWYQHKPGKAPKLLIYAASSLQSGVPSRFSGSGSGTDFTLTISSLQPEDFATYYCQEANSFTWTFGQGTKVEIK

SEQ ID NO: 13072 - protein, 107 aa, Homo sapiens
DIQMTQSPSSVSASVGDRVTITCRASQGISSWLAWYQHKPGKAPKLLIYAASSLQSGVPSRFSGSGSGTDFTLTISSLQPEDFATYYCQQTNSFTWTFGQGTKVEIK

SEQ ID NO: 13073 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPFTFGPGTKVDIK

SEQ ID NO: 13074 - protein, 107 aa, Homo sapiens
DIQMTQSPSSVSASVGDRVTITCRASQGISSWLAWYQHKPGKAPKLLIYAASSLQSGVPSRFSGSGSGTDFTLTISSLQPEDFATYYCQQANSFPITFGQGTRLEIK

SEQ ID NO: 13075 - protein, 107 aa, Homo sapiens
DIQMTQSPSSVSASVGDRVTITCRASQGISSWLAWYQHKPGKAPKLLIYAASSLQSGVPSRFSGSGSGTDFTLTISSLQPEDFATYYCQQANGFPITFGQGTRLEIK

SEQ ID NO: 13076 - protein, 107 aa, Homo sapiens
AIQLTQSPSSLSASVGDRVTITCRASQGISSALAWYQQKPGKAPKLLIYDASSLESGVPSRFSGSGSGTDFTLTISSLQPEDFATYYCQQFNSYPRTFGQGTKVEIK

SEQ ID NO: 13077 - protein, 107 aa, Homo sapiens
AIQLTQSPSSLSASVGDRVTITCRASQGISSALAWYQQKPGKAPKLLIYVASSLESGVPSRFSGSGSGTDFTLTITSLQPEDFATYYCQQFNSYPITFGQGTRLEIK

SEQ ID NO: 13078 - protein, 111 aa, Artificial Sequence
  Description of Artificial Sequence: Synthetic polypeptide
  Variable domain
QSALTQPPSVSGSPGQSVTISCAGTSSDVGYGNYVSWYQQPPGTAPKLLIFAVSYRASGVPDRFSGSKSGNTASLTISGLQAEDEADYYCASYRSSNNAAVFGGGTKLTVL

SEQ ID NO: 13079 - protein, 111 aa, Artificial Sequence
  Description of Artificial Sequence: Synthetic polypeptide
  Variable domain
QSALTQPRSVSGSPGQSVTISCAGTSSDVGYGNYVSWYQQHPGTAPKLMIFAVSYRASGIPDRFSGSKSGNTAFLTISGLQAEDEADYYCASYRSSNNAAVFGGGTKLTVL

SEQ ID NO: 13080 - protein, 111 aa, Artificial Sequence
  Description of Artificial Sequence: Synthetic polypeptide
  Variable domain
QSVLTQPPSVSGSPGQTVTISCAGTSSDVGYGNYVSWYQQLPGTAPKLMIFAVSYRASGIPDRFSGSKSGNTASLTISGLQSEDEADYYCASYRSSNNAAVFGGGTKLTVL

SEQ ID NO: 13081 - protein, 111 aa, Artificial Sequence
  Description of Artificial Sequence: Synthetic polypeptide
  Variable domain
QSVLTQPPSVSGSPGQTVTISCAGTSSDVGYGNYVSWYQQPPGTAPKLMIFAVSYRASGIPDRFSGSKSGNTAFLTISGLQSEDEADYYCASYRSSNNAAVFGGGTKLTVL

SEQ ID NO: 13082 - protein, 113 aa, Artificial Sequence
  Description of Artificial Sequence: Synthetic polypeptide
  Variable domain
DIVMTQSPDSLAASLGERVTINCKSSQSVLFSSNQKNYLAWYQQRPGQSPKLLIYWASIRESGVPDRFSGSGSGTDFTLTISSLQAEDVAVYYCQQGYSFPYSFGSGTRLEIK

SEQ ID NO: 13083 - protein, 113 aa, Artificial Sequence
  Description of Artificial Sequence: Synthetic polypeptide
  Variable domain
DIVMTQSPDSLTASLGERVTINCKSSQSVLFSSNQKNYLAWYQQKPGQSPKLLIYWASIRESGVPDRFSGSGSGTDFTLTISSLQPEDVAVYYCQQGYSFPYSFGQGTRLEIR

SEQ ID NO: 13084 - protein, 113 aa, Artificial Sequence
  Description of Artificial Sequence: Synthetic polypeptide
  Variable domain
DIVMTQSPDSLAVSEGERVTINCKSSQSVLFSSNQKNYLAWYQQKPGQSPRLLIYWASIRESGVPDRFSGSGSATDFTLTISSLQAEDVAVYYCQQGYSFPYSFGQGTRLEIR

SEQ ID NO: 13085 - protein, 113 aa, Artificial Sequence
  Description of Artificial Sequence: Synthetic polypeptide
  Variable domain
DIVMTQSPTSVAVSLGERATINCKSSQSVLFSSNQKNYLAWYQQKPGQPPRLLIYWASIRESGVPDRFSGSGSGTDFTLTISSLQPEDVAVYYCQQGYSFPYSFGQGTRLEIR

SEQ ID NO: 13086 - protein, 113 aa, Artificial Sequence
  Description of Artificial Sequence: Synthetic polypeptide
  Variable domain
DIVMTQSPDSLAVSLGEKVTINCKSSQSVLFSSNQKNYLAWYQQRPGQPPKLLIYWASIRESGVPDRFSGSGSATDFTLTISSLQPEDVAVYYCQQGYSFPYSFGQGTRLEIK

SEQ ID NO: 13087 - protein, 113 aa, Artificial Sequence
  Description of Artificial Sequence: Synthetic polypeptide
  Variable domain
DIVMTQTPDSLAVSAGERVTINCKSSQSVLFSSNQKNYLAWYQQKPGQSPKLLIYWASIRESGVPDRFSGSGSGTDFTLTISSLQPEDVTVYYCQQGYSFPYSFGQGTRLEIK

SEQ ID NO: 13088 - protein, 113 aa, Artificial Sequence
  Description of Artificial Sequence: Synthetic polypeptide
  Variable domain
DIVMTQTPTSLAPSAGERATINCKSSQSVLFSSNQKNYLAWYQQKPGQPPKLLIYWASIRESGVPDRFSGSGSATDFTLTISSLQPEDVAVYYCQQGYSFPYSFGSGTRLEIK

SEQ ID NO: 13089 - protein, 113 aa, Artificial Sequence
  Description of Artificial Sequence: Synthetic polypeptide
  Variable domain
EIVMTQSPSSVTASAGEKVTINCKSSQSVLWRSNQKNYLAWYQQRLGQSPRLLISWASIRESGVPDRFSGSGSTTDFTLTISSFQPEDAAVYYCQQGYSFPYTFGSGTRLEIK

SEQ ID NO: 13090 - protein, 113 aa, Artificial Sequence
  Description of Artificial Sequence: Synthetic polypeptide
  Variable domain
DIVMTQTPSSVTAAVGEKVAINCKSSQSVLYNPNQKSYLAWYQQRPGQSPRLLIYWASTRESGVPDRFSGSGSTTDFALTISSFQPEDAAVYYCQQGYSFPYSFGSGTRLEIR

SEQ ID NO: 13091 - protein, 113 aa, Artificial Sequence
  Description of Artificial Sequence: Synthetic polypeptide
  Variable domain
DVVMTQSPSSVTASVGEKVTINCKSSQSVLYTSNHKNYLAWYQQRLGQSPRLLIYWASTRESGVPDRFSGSGSTTDFTLTISSFQPEDAAVYYCQQGWSFPYSFGSGTRLEIK

SEQ ID NO: 13092 - protein, 113 aa, Artificial Sequence
  Description of Artificial Sequence: Synthetic polypeptide
  Variable domain
DIVMTQTPSSVTASAGEKVTINCKSSQSVLYNSNQKNYLAWYQQRLGQSPRLLIYWASTRESGVPDRFSGSGSTTDFTLTISSFQPEDAAVYYCQQGWSFPYTFGSGTRLEIK

SEQ ID NO: 13093 - protein, 113 aa, Artificial Sequence
  Description of Artificial Sequence: Synthetic polypeptide
  Variable domain
DIQLTQSPSSVTASAGEKVTINCKSSQSVLYGSNQKNYLAWYQQRLGQSPRLLIYWASTRESGVPDRFSGSGSTTDFTLTISSFQPEDAAVYYCQQGWSFPYTFGSGTRLEIK

SEQ ID NO: 13094 - protein, 113 aa, Artificial Sequence
  Description of Artificial Sequence: Synthetic polypeptide
  Variable domain
DIQLTQSPSSVTVSVGEKVTINCKSSQSVLYNSNQKNYLAWYQQRLGQSPRLLIYWASTRESGVPDRFSGSGSTTDFTLTISSFQPEDAAVYYCQQGWSFPYTFGSGTRLEIK

SEQ ID NO: 13095 - protein, 113 aa, Artificial Sequence
  Description of Artificial Sequence: Synthetic polypeptide
  Variable domain
DIQMTQSPSSVTASAGEKVTINCKSSQSVLYNSNQKNYLAWYQQRLGQSPRLLIYWASTRESGVPDRFSGSGSTTDFTLTISSFQPEDAAVYYCQQGWSFPYTFGSGTRLEIK

SEQ ID NO: 13096 - protein, 113 aa, Artificial Sequence
  Description of Artificial Sequence: Synthetic polypeptide
  Variable domain
DIVMTQTPASVTASAGEKVTINCKSSQSVLFSSNQKNYLAWYQQRVGQSPRLLIYWASTRESGVPDRFSGSGSTTDFTLTISNFQPEDAAVYYCQQGYSFPYSFGSGTRLEIR

SEQ ID NO: 13097 - protein, 113 aa, Artificial Sequence
  Description of Artificial Sequence: Synthetic polypeptide
  Variable domain
DVVMTQSPSSVTASAGEKVTINCKSSQSVLWSSNQKNYLAWYQQRVGQSPRLLIYWASTRESGVPDRFSGSGSTTDFTLTISNFQPEDAAVYYCQQGYSFPYSFGSGTRLEIR

SEQ ID NO: 13098 - protein, 111 aa, Artificial Sequence
  Description of Artificial Sequence: Synthetic polypeptide
  Variable domain
QSVLTQPPSVSGSPGKTVTISCAGTSSDVGYGNYVSWYQQLPGTAPKLLIFAVSYRASGIPDRFSGSKSGNTAFLTISGLQSEDEADYYCASYRSSNNAAVFGGGTHLTVL

SEQ ID NO: 13099 - protein, 111 aa, Artificial Sequence
  Description of Artificial Sequence: Synthetic polypeptide
  Variable domain
QSVLTQPPSVSGTLGKTLTISCAGTSTDVGYGNYVSWYQQLPGTAPKLLIFAVSYRASGIPDRFSGSKSGNTAFLTISGLQSEDEADYYCASYRSSNNAAVFGGGTHLTVL

SEQ ID NO: 13100 - protein, 111 aa, Artificial Sequence
  Description of Artificial Sequence: Synthetic polypeptide
  Variable domain
QSALTQPPSVSGTLGKTLTISCAGTSTDVGYGNYVSWYQQLPGTAPKLLIFAVSYRASGIPDRFSGSKSGNTAFLTISGLQSEDEADYYCASYRSSNNAAVFGGGTHLTVL

SEQ ID NO: 13101 - protein, 111 aa, Artificial Sequence
  Description of Artificial Sequence: Synthetic polypeptide
  Variable domain
LPVLTQPPSVSGTLGKTLTISCAGTSSDVGYGNYVSWYQQLPGTAPKLLIYAVSYRASGIPDRFSGSKSGNTASLSISGLQSEDEADYYCASYRSSNKNAVFGGGTHLTVL

SEQ ID NO: 13102 - protein, 111 aa, Artificial Sequence
  Description of Artificial Sequence: Synthetic polypeptide
  Variable domain
QSALTQPPSVSGSPGKTVTISCAGTSSDVGYGNYVSWYQKLPGTAPKLLIYAVSYRASGIPDRFSGSRSGNTASLTISGLQSEDEADYYCASYRITNRHSVFGGGTHLTVL

SEQ ID NO: 13103 - protein, 111 aa, Artificial Sequence
  Description of Artificial Sequence: Synthetic polypeptide
  Variable domain
QSALTQPPSVSGTLGKTVTISCAGTSSDVGYGNYVSWYQKLPGTAPKLLIYAVTYRASGIPDRFSGSKSGNTASLTISGLQSEDEADYYCASYRRSTNVGVFGGGTHLTVL

SEQ ID NO: 13104 - protein, 111 aa, Artificial Sequence
  Description of Artificial Sequence: Synthetic polypeptide
  Variable domain
QAVLTQPPSVSGTLGKTVTISCAGTSSDVGYGNYVSWYQKLPGTAPKLLIYAVSYRASGIPDRFSGSKSGNTASLTISGLQSEDEADYHCASYRTSNNVAVFGGGTKLTVL

SEQ ID NO: 13105 - protein, 112 aa, Mus musculus
DIVLTQSPDSLAVSLGERATINCKSSESVDSYANSFMHWYQQKPGQPPKLLIYRASTRESGVPDRFSGSGSRTDFTLTISSLQAEDVAVYYCQQSKEDPLTFGGGTKVEIKR

SEQ ID NO: 13106 - protein, 112 aa, Mus musculus
DIVMTQSPDSLAVSLGERATINCKSSESVDSYANSFMHWYQQKPGQPPKLLIYRASTRESGVPDRFSGSGSGTDFTLTISSLQAEDVAVYYCQQSKEDPLTFGGGTKVEIKR

SEQ ID NO: 13107 - protein, 112 aa, Mus musculus
DIVMTQSPDSLAVSLGERATINCKSSESVDSYANSFLHWYQQKPGQPPKLLIYRASTRESGVPDRFSGSGSGTDFTLTISSLQAEDVAVYYCQQSKEDPLTFGGGTKVEIKR

SEQ ID NO: 13108 - protein, 112 aa, Mus musculus
DIVLTQSPASLAVSLGQRATISCRASESVDSYANSFMHWYQQKPGQPPKLLIYRASNLESGIPARFSGSGSRTDFTLTINPVEADDVATYYCQQSKEDPLTFGSGTKLEMKR

SEQ ID NO: 13109 - protein, 219 aa, Homo sapiens
ELQMTQSPSLLSASTGDRVTISCRASQSISSYLNWYQQKPGKAPKLLIYTRSSLQSGVPSRFSGSGSGTDFTLTISSLQPEDFATYYCQQSYSTPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSLPVTKSFNRGRVLVLDN

SEQ ID NO: 13110 - protein, 109 aa, Homo sapiens
DIELTQPPSVSVAPGQTARISCSGDSIGNKYVHWYQQKPGQAPVLVIYADSDRPSGIPERFSGSNSGNTATLTISGTQAEDEADYYCQAYDSSMLRVFGGGTKLTVLGQ

SEQ ID NO: 13111 - protein, 110 aa, Homo sapiens
DIELTQPPSVSVAPGQTARISCSGDSIGNKYVHWYQQKPGQAPVLVIYADSDRPSGIPERFSGSNSGNTATLTISGTQAEDEADYYCQSYANYHDSWVFGGGTKLTVLGQ

SEQ ID NO: 13112 - protein, 110 aa, Homo sapiens
DIELTQPPSVSVAPGQTARISCSGDSIGNKYVHWYQQKPGQAPVLVIYADSDRPSGIPERFSGSNSGNTATLTISGTQAEDEADYYCQSYASDYTSWVFGGGTKLTVLGQ

SEQ ID NO: 13113 - protein, 110 aa, Homo sapiens
DIELTQPPSVSVAPGQTARISCSGDSIGNKYVHWYQQKPGQAPVLVIYADSDRPSGIPERFSGSNSGNTATLTISGTQAEDEADYYCQSYAHYHDIWVFGGGTKLTVLGQ

SEQ ID NO: 13114 - protein, 109 aa, Homo sapiens
DIELTQPPSVSVAPGQTARISCSGDSIGNKYVHWYQQKPGQAPVLVIYADSDRPSGIPERFSGSNSGNTATLTISGTQAEDEADYYCQAHDSLYSRVFGGGTKLTVLGQ

SEQ ID NO: 13115 - protein, 114 aa, Homo sapiens
DIVMTQSPDSLAVSLGERATINCRSSQSILYGINNNFLGWYQQKPGQPPKLLIYWASTRESGVPDRFSGSGSGTDFTLTISSLQAEDVAVYYCQQYYNHPHTFGQGTKVEIKRT

SEQ ID NO: 13116 - protein, 113 aa, Homo sapiens
DIVMTQSPDSLAVSLGERATINCRSSQSILYGINNNFLGWYQQKPGQPPKLLIYWASTRESGVPDRFSGSGSGTDFTLTISSLQAEDVAVYYCQQYAFGWTFGQGTKVEIKRT

SEQ ID NO: 13117 - protein, 114 aa, Homo sapiens
DIVMTQSPDSLAVSLGERATINCRSSQSILYGINNNFLGWYQQKPGQPPKLLIYWASTRESGVPDRFSGSGSGTDFTLTISSLQAEDVAVYYCLQYSDEPWTFGQGTKVEIKRT

SEQ ID NO: 13118 - protein, 114 aa, Homo sapiens
DIVMTQSPDSLAVSLGERATINCRSSQSILYGINNNFLGWYQQKPGQPPKLLIYWASTRESGVPDRFSGSGSGTDFTLTISSLQAEDVAVYYCQQYAYEPNTFGQGTKVEIKRT

SEQ ID NO: 13119 - protein, 114 aa, Homo sapiens
DIVMTQSPDSLAVSLGERATINCRSSQSILYGINNNFLGWYQQKPGQPPKLLIYWASTRESGVPDRFSGSGSGTDFTLTISSLQAEDVAVYYCLQYAFSPWTFGQGTKVEIKRT

SEQ ID NO: 13120 - protein, 108 aa, Homo sapiens
DIELTQPPSVSVAPGQTARISCSGDNIGSYYVYWYQQKPGQAPVLVIYDDNDRPSGIPERFSGSNSGNTATLTISGTQAEDEADYYCQSYDFPSIVFGGGTKLTVLGQ

SEQ ID NO: 13121 - protein, 108 aa, Homo sapiens
DIELTQPPSVSVAPGQTARISCSGDNIGSYYVYWYQQKPGQAPVLVIYDDNDRPSGIPERFSGSNSGNTATLTISGTQAEDEADYYCQSYDSYIFVFGGGTKLTVLGQ

SEQ ID NO: 13122 - protein, 108 aa, Homo sapiens
DIELTQPPSVSVAPGQTARISCSGDNIGSYYVYWYQQKPGQAPVLVIYDDNDRPSGIPERFSGSNSGNTATLTISGTQAEDEADYYCSTYDAFTFVFGGGTKLTVLGQ

SEQ ID NO: 13123 - protein, 108 aa, Homo sapiens
DIELTQPPSVSVAPGQTARISCSGDNIGSYYVYWYQQKPGQAPVLVIYDDNDRPSGIPERFSGSNSGNTATLTISGTQAEDEADYYCQSYDKYVFVFGGGTKLTVLGQ

SEQ ID NO: 13124 - protein, 110 aa, Homo sapiens
DIELTQPPSVSVAPGQTARISCSGDSLRSYFVSWYQQKPGQAPVLVIYDDDDRPSGIPERFSGSNSGNTATLTISGTQAEDEADYYCASWDTLSDVEVFGGGTKLTVLGQ

SEQ ID NO: 13125 - protein, 110 aa, Homo sapiens
DIELTQPPSVSVAPGQTARISCSGDSLRSYFVSWYQQKPGQAPVLVIYDDDDRPSGIPERFSGSNSGNTATLTISGTQAEDEADYYCASWDPPSAFEVFGGGTKLTVLGQ

SEQ ID NO: 13126 - protein, 109 aa, Homo sapiens
DIELTQPPSVSVAPGQTARISCSGDSLRSYFVSWYQQKPGQAPVLVIYDDDDRPSGIPERFSGSNSGNTATLTISGTQAEDEADYYCASWDNDHFEVFGGGTKLTVLGQ

SEQ ID NO: 13127 - protein, 109 aa, Homo sapiens
DIELTQPPSVSVAPGQTARISCSGDKLGSYFVYWYQQKPGQAPVLVIYDDDNRPSGIPERFSGSNSGNTATLTISGTQAEDEADYYCQSFGISNFYVFGGGTKLTVLGQ

SEQ ID NO: 13128 - protein, 108 aa, Homo sapiens
DIELTQPPSVSVAPGQTARISCSGDKLGSYFVYWYQQKPGQAPVLVIYDDDNRPSGIPERFSGSNSGNTATLTISGTQAEDEADYYCGSWAYLGDVFGGGTKLTVLGQ

SEQ ID NO: 13129 - protein, 112 aa, Homo sapiens
DIVLTQPPSVSGAPGQRVTISCSGSSSNIGSNYVIWYQQLPGTAPKLLIYDDTNRPSGVPDRFSGSKSGTSASLAITGLQSEDEADYYCSTYDNYQAGWVFGGGTKLTVLGQ

SEQ ID NO: 13130 - protein, 108 aa, Artificial Sequence
  Description of Artificial Sequence: Synthetic polypeptide
  synthetic construct
EIVLTQSPGTLSLSPGERATLSCSVSSSISSTNLHWYQQKPGQAPRLLIYGTSYLASGIPDRFSGSGSGTDFTLTISRLEPEDFAVYYCQQWSSYPYSFGQGTKLEIK

SEQ ID NO: 13131 - protein, 108 aa, Artificial Sequence
  Description of Artificial Sequence: Synthetic polypeptide
  synthetic construct
EIVLTQSPGTLSLSPGERATLSCSVSSSISSTNLHWYQQKPGQAPRLLIYGTSRLRSGIPDRFSGSGSGTDFTLTISRLEPEDFAVYYCQQWSSYPYSFGQGTKLEIK

SEQ ID NO: 13132 - protein, 108 aa, Artificial Sequence
  Description of Artificial Sequence: Synthetic polypeptide
  synthetic construct
DIQMTQSPSSLSASVGDRVTITCSVSSSVSSIYLHWYQQKPGKAPKLLIYSTSNLASGVPSRFSGSGSGTDFTLTISSLQPEDFATYYCIQYSGYPLTFGGGTKVEIK

SEQ ID NO: 13133 - protein, 108 aa, Artificial Sequence [sequence omitted]

SEQ ID NO: 13134 - protein, 108 aa, Artificial Sequence
  Description of Artificial Sequence: Synthetic polypeptide
  synthetic construct
DIQMTQSPSSLSASVGDRVTITCSVSSSVRSIYLHWYQQKPGKAPKLLIYSTSNLASGVPSRFSGSGSGTDFTLTISSLQPEDFATYYCQVYRGYPLTFGGGTKVEIK

SEQ ID NO: 13135 - protein, 112 aa, Mus musculus
DIVMTQAAFSNPVTLGTSVSISCRSSKSLLHSNGITYLYWYLQKPGQSPQLLIYQMSNLASGVPDRFSSSGSGTDFTLRISRVEAEDVGVYYCAQNLELPYTFGGGTKLEIK

SEQ ID NO: 13136 - protein, 111 aa, Mus musculus
NIVLTQSPASLAVSLGQRATISCRASESVDSNGNSFIHWYQQKPGQPPKLLIYVASKLESGVPARFSGSGSRTDFTLTIDPVEAEDVATYYCQQNNEYPLTFGAGTKLELK

SEQ ID NO: 13137 - protein, 113 aa, Artificial Sequence
  Description of Artificial Sequence: Synthetic polypeptide
  Synthetic (light chain variable region of AT-Vk1)
DILMTQSPSSLTASVGDRVTMTCKSSQSLLASGNQNNYLAWHQQKPGKAPKMLIIWASTRVSGVPDRFIGSGSGTDFTLTISSLQAEDVAVYYCQQSYSAPLTFGQGTKLEIK

SEQ ID NO: 13138 - protein, 113 aa, Artificial Sequence
  Description of Artificial Sequence: Synthetic polypeptide
  Synthetic (light chain variable region of AT-Vk2)
DILMTQSPSSLSASVGDRVTITCKSSQSLLASGNQNNYLAWHQQKPGKAPKMLIIWASTRVSGVPDRFIGSGSGTDFTLTISSLQAEDVAVYYCQQSYSAPLTFGQGTKLEIK

SEQ ID NO: 13139 - protein, 113 aa, Artificial Sequence
  Description of Artificial Sequence: Synthetic polypeptide
  Synthetic (AT-Vk3)
DIQMTQSPSSLSASVGDRVTITCKSSQSLLASGNQNNYLAWHQQKPGKAPKMLIIWASTRVSGVPDRFIGSGSGTDFTLTISSLQAEDVAVYYCQQSYSAPLTFGQGTKLEIK

SEQ ID NO: 13140 - protein, 113 aa, Artificial Sequence
  Description of Artificial Sequence: Synthetic polypeptide
  Synthetic (AT-Vk4)
DIQMTQSPSSLSASVGDRVTITCKSSQSLLASGNQNNYLAWHQQKPGKAPKMLIIWASTRVSGVPDRFSGSGSGTDFTLTISSLQAEDVAVYYCQQSYSAPLTFGQGTKLEIK

SEQ ID NO: 13141 - protein, 113 aa, Artificial Sequence
  Description of Artificial Sequence: Synthetic polypeptide
DIMMSQSPSSLTVSVGEKVTVSCKSSQSLLYTSSQKNYLAWYQQKPGQSPKLLIYWASTRESGVPDRFTGSGSGTDFTLTITSVKADDLAVYYCQQYYAYPWTFGGGTKLEIK

SEQ ID NO: 13142 - protein, 107 aa, Homo sapiens; identical to SEQ ID NO: 12925

SEQ ID NO: 13143 - protein, 107 aa, Artificial Sequence [sequence omitted]

SEQ ID NO: 13144 - protein, 113 aa, Artificial Sequence
  Description of Artificial Sequence: Synthetic polypeptide
  cMu9Vk amino acid sequence
DILQTQTPLSLPVSLGDQASISCRSSQSIVHSNGNTYLEWYLQKPGQSPKLLIYKVSNRFSGVPDRFSGTGSGTDFTVRISRVEAEDLGLYYCFQGSRVPYTFGGGTKLEIKR

SEQ ID NO: 13145 - protein, 113 aa, Artificial Sequence
  Description of Artificial Sequence: Synthetic polypeptide
  hMu9Vk amino acid sequence
DIQLTQSPGTLSLSPGERATLSCRSSQSIVHSNGNTYLEWYLQKPGQAPRLLIYKVSNRFSGVPDRFSGSGSGTDFTLTISRLEPEDFAVYYCFQGSRVPYTFGGGTKVEIKR

SEQ ID NO: 13146 - protein, 106 aa, Mus musculus
NIVMTQSPKSMSMSVGERVTLNCKASEDVNTYVSWYQQQPEQSPKLLIYGASNRYTGVPDRFTGGGSTTDFTLTISSVQAEDLADYFCGQSFSYPTFGTGTKLEIK

SEQ ID NO: 13147 - protein, 106 aa, Mus musculus
NIVMTQSPKSMSMSVGERVTLSCKASEDVVTYVSWYQQKPDQSPKLLIYGASNRYTGVPDRFTGSGSATDFTLTISSVQAEDLADYYCGQTFSYPTFGTGTKLEIK

SEQ ID NO: 13148 - protein, 106 aa, Artificial Sequence
  Description of Artificial Sequence: Synthetic polypeptide
  light chain variable domain, hMab 2F11-c11
DIQMTQSPSSLSASVGDRVTITCRASEDVNTYVSWYQQKPGKAPKLLIYGASNRYTGVPSRFSGSGSGTDFTLTISSLQPEDFATYYCGQSFSYPTFGQGTKLEIK

SEQ ID NO: 13149 - protein, 106 aa, Artificial Sequence
  Description of Artificial Sequence: Synthetic polypeptide
  light chain variable domain, hMab 2F11-d8
DIQMTQSPSSLSASVGDRVTITCKASEDVNTYVSWYQQKPGKAPKLLIYGASNRYTGVPSRFSGSGSGTDFTLTISSLQPEDFATYYCGQSFSYPTFGQGTKLEIK

SEQ ID NO: 13150 - protein, 106 aa, Artificial Sequence; identical to SEQ ID NO: 8707
  Description of Artificial Sequence: Synthetic polypeptide
  light chain variable domain, hMab 2F11-e7

SEQ ID NO: 13151 - protein, 106 aa, Artificial Sequence
  Description of Artificial Sequence: Synthetic polypeptide
  light chain variable domain, hMab 2F11-f12
DIQMTQSPSSLSASVGDRVTITCRASEDVNTYVSWYQQKPGKAPKLLIYGASSLQSGVPSRFSGSGSGTDFTLTISSLQPEDFATYYCGQSFSYPTFGQGTKLEIK

SEQ ID NO: 13152 - protein, 106 aa, Artificial Sequence
  Description of Artificial Sequence: Synthetic polypeptide
  light chain variable domain, hMab 2F11-g1
EIVLTQSPGTLSLSPGERATLSCRASEDVNTYLAWYQQKPGQAPRLLIYGASSRATGIPDRFSGSGSGTDFTLTISRLEPEDFAVYYCGQSFSYPTFGQGTKLEIK

SEQ ID NO: 13153 - protein, 106 aa, Mus musculus
KIVMTQSPKSMSVSVGERVSLSCKASEDVGTYVSWYQQKPEQSPKLLIYGSSNRYTGVPDRFTGSGSATDFTLTISSVQAEDLADYSCGQSFTYPTFGTGTKLEIK

SEQ ID NO: 13154 - protein, 106 aa, Mus musculus
NIVMTQSPKSMSMSVGERVTLSCKASEDVVTYVSWYQQKPEQSPKLLIYGASNRYTGVPDRFTGSGSATDFTLTISSIQAEDLADYYCGQTFSYPTFGTGTKLEIK

SEQ ID NO: 13155 - protein, 107 aa, Homo sapiens
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIK

SEQ ID NO: 13156 - protein, 113 aa, Artificial Sequence; identical to SEQ ID NO: 8478
  Description of Artificial Sequence: Synthetic polypeptide
  humanized S2C6 light chain variable domain variant

SEQ ID NO: 13157 - protein, 112 aa, Artificial Sequence
  Description of Artificial Sequence: Synthetic polypeptide
  humanized VL
DIVMTQSPDSLAVSLGERATINCKSSQSLFNSRTRKNYLAWYQQKPGQPPKLLIYWASTRESGVPDRFSGSGSGTDFTLTISSLQAEDVAVYYCMQSFNLRTFGQGTKVEIK

SEQ ID NO: 13158 - protein, 112 aa, Artificial Sequence
  Description of Artificial Sequence: Synthetic polypeptide
  humanized VL
DIVMTQSPDSLAVSLGERATINCKSSQSLFNSRTRKNYLAWYQQKPGQPPKLLIYWASARDSGVPDRFSGSGSGTDFTLTISSLQAEDVAVYYCMQSFNLRTFGQGTKVEIK

SEQ ID NO: 13159 - protein, 112 aa, Artificial Sequence
  Description of Artificial Sequence: Synthetic polypeptide
  humanized VL
DIVMTQSPSSLAVSLGERATMSCKSSQSLFNSRTRKNYLAWYQQKPGQSPKLLIYWASARDSGVPARFTGSGSETYFTLTISRVQAEDLAVYYCMQSFNLRTFGQGTKVEIK

SEQ ID NO: 13160 - protein, 112 aa, Artificial Sequence
  Description of Artificial Sequence: Synthetic polypeptide
  humanized VL
DIVMTQSPDSLAVSLGERATMSCKSSQSLFNSRTRKNYLAWYQQKPGQPPKLLIYWASARDSGVPDRFSGSGSETYFTLTISRVQAEDLAVYYCMQSFNLRTFGQGTKVEIK

SEQ ID NO: 13161 - protein, 112 aa, Artificial Sequence
  Description of Artificial Sequence: Synthetic polypeptide
  humanized VL
DIVMTQSPDSLAVSLGERATMSCKSSQSLFNSRTRKNYLAWYQQKPGQPPKLLIYWASARDSGVPDRFTGSGSETYFTLTISRVQAEDVAVYYCMQSFNLRTFGQGTKVEIK

SEQ ID NO: 13162 - protein, 112 aa, Artificial Sequence
  Description of Artificial Sequence: Synthetic polypeptide
  humanized VL
DIVMTQSPDSLAVSLGERATMSCKSSQSLFNSRTRKNYLAWYQQKPGQPPKLLIYWASARDSGVPDRFTGSGSETYFTLTISSLQAEDLAVYYCMQSFNLRTFGQGTKVEIK

SEQ ID NO: 13163 - protein, 219 aa, Artificial Sequence
  Description of Artificial Sequence: Synthetic polypeptide
  humanized VL
DIVMTQSPDSLAVSLGERATINCKSSQSLFNSRTRKNYLAWYQQKPGQPPKLLIYWASTRESGVPDRFSGSGSGTDFTLTISSLQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13164 - protein, 219 aa, Artificial Sequence
  Description of Artificial Sequence: Synthetic polypeptide
  humanized VL
DIVMTQSPDSLAVSLGERATINCKSSQSLFNSRTRKNYLAWYQQKPGQPPKLLIYWASARDSGVPDRFSGSGSGTDFTLTISSLQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13165 - protein, 219 aa, Artificial Sequence
  Description of Artificial Sequence: Synthetic polypeptide
  humanized VL
DIVMTQSPSSLAVSLGERATMSCKSSQSLFNSRTRKNYLAWYQQKPGQSPKLLIYWASARDSGVPARFTGSGSETYFTLTISRVQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13166 - protein, 219 aa, Artificial Sequence
  Description of Artificial Sequence: Synthetic polypeptide
  humanized VL
DIVMTQSPDSLAVSLGERATMSCKSSQSLFNSRTRKNYLAWYQQKPGQPPKLLIYWASARDSGVPDRFSGSGSETYFTLTISRVQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13167 - protein, 219 aa, Artificial Sequence
  Description of Artificial Sequence: Synthetic polypeptide
  humanized VL
DIVMTQSPDSLAVSLGERATMSCKSSQSLFNSRTRKNYLAWYQQKPGQPPKLLIYWASARDSGVPDRFTGSGSETYFTLTISRVQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13168 - protein, 219 aa, Artificial Sequence
  Description of Artificial Sequence: Synthetic polypeptide
  humanized VL
DIVMTQSPDSLAVSLGERATMSCKSSQSLFNSRTRKNYLAWYQQKPGQPPKLLIYWASARDSGVPDRFTGSGSETYFTLTISSLQAEDLAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13169 - protein, 219 aa, Artificial Sequence
  Description of Artificial Sequence: Synthetic polypeptide
  humanized VL
DIVMTQSPDSLAVSLGERATINCKSSQSLFNSRTRKNYLAWYQQKPGQPPKLLIYWASARDSGVPDRFTGSGSETYFTLTISSLQAEDVAVYYCMQSFNLRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13170 - protein, 112 aa, Artificial Sequence
  Description of Artificial Sequence: Synthetic polypeptide
DVLMTQIPLSLPVSLGDQASISCRSSQNIVHSNGNTYLDWYLQKPGQSPNLLIYKVSNRFSGVPDRFRGSGSGTDFTLKISRVEAEDLGVYYCFQYSHVPWTFGGGTKLEIK

SEQ ID NO: 13171 - protein, 106 aa, Artificial Sequence
  Description of Artificial Sequence: Synthetic polypeptide
QIVLTQSPAIMSASPGEKVTMTCSASSSVTYMYWYQQKPGSSPRLLIYDTSNLASGVPVRFSGSGSGTSYSLTISRMEAEDAATYYCQQWSSHIFTFGSGTKLEIK

SEQ ID NO: 13172 - protein, 106 aa, Artificial Sequence [sequence omitted]

SEQ ID NO: 13173 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLEIK

SEQ ID NO: 13174 - protein, 107 aa, Artificial Sequence
  Description of Artificial Sequence: Synthetic polypeptide
QSVLTQPPSLSVSPGQTASITCSGDKLGDKYASWYQQKPGQSPVLVIYQDRKRPSGIPERFSGSNSGNTATLTISGTQAMDEADYYCQAWDSSTPYVFGTGTKVTVL

SEQ ID NO: 13175 - protein, 107 aa, Artificial Sequence
  Description of Artificial Sequence: Synthetic polypeptide
QSALTQPPSVSVSPGQTASITCSGDKLGDKYASWYQLKPAQSPVWVIYQDTKRSSGIPERISGSNSGNTSTLTITGTQAMDEADYYCQAWDSSTAVVFGGGTKLTVL

SEQ ID NO: 13176 - protein, 106 aa, Artificial Sequence
  Description of Artificial Sequence: Synthetic polypeptide
  antibody variable region sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWWTFGQGTKVEIK

SEQ ID NO: 13177 - protein, 108 aa, Artificial Sequence
  Description of Artificial Sequence: Synthetic polypeptide
  antibody variable region sequence
EIVLTQSPATLSLSPGERATLSCRASQSVSSYLAWYQQKPGQAPRLLIFDASNRATGIPARFSGSGSGTDFTLTISSLEPEDFAVYYCQQRSNWPPWTFGQGTKVEIK

SEQ ID NO: 13178 - protein, 107 aa, Artificial Sequence
  Description of Artificial Sequence: Synthetic polypeptide
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGQGTKLELK

SEQ ID NO: 13179 - protein, 107 aa, Artificial Sequence
  Description of Artificial Sequence: Synthetic polypeptide
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGQGTKLELK

SEQ ID NO: 13180 - protein, 107 aa, Artificial Sequence
  Description of Artificial Sequence: Synthetic polypeptide
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGQGTKLELK

SEQ ID NO: 13181 - protein, 107 aa, Artificial Sequence
  Description of Artificial Sequence: Synthetic polypeptide
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGQGTKLELK

SEQ ID NO: 13182 - protein, 107 aa, Artificial Sequence
  Description of Artificial Sequence: Synthetic polypeptide
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGQGTKLELK

SEQ ID NO: 13183 - protein, 107 aa, Artificial Sequence
  Description of Artificial Sequence: Synthetic polypeptide
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGQGTKLELK

SEQ ID NO: 13184 - protein, 107 aa, Artificial Sequence
  Description of Artificial Sequence: Synthetic polypeptide
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKLELK

SEQ ID NO: 13185 - protein, 222 aa, Artificial Sequence
  Description of Artificial Sequence: Synthetic polypeptide
  EGFR construct
MATGSRTSLLLAFGLLCLPWLQEGSADILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 13186 - protein, 227 aa, Artificial Sequence
  Description of Artificial Sequence: Synthetic polypeptide
  IGF-1R construct
MATGSRTSLLLAFGLLCLPWLQEGSADIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAAPDVQDCPECTLQENPFFSQPGAPILQCMGCCFSRAYPTPLRSKKTMLVQKNVTSESTCCVAKSYNRVTVMGGFKVENHTACHCSTC

SEQ ID NO: 13187 - protein, 286 aa, Artificial Sequence
  Description of Artificial Sequence: Synthetic polypeptide
  IGF-1R construct
MATGSRTSLLLAFGLLCLPWLQEGSADIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIKAAASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQ

SEQ ID NO: 13188 - protein, 278 aa, Artificial Sequence
  Description of Artificial Sequence: Synthetic polypeptide
  EGFR construct
MATGSRTSLLLAFGLLCLPWLQEGSASKEPLRPRCRPINATLAVEKEGCPVCITVNTTICAGYCPTMTRVLQGVLPALPQVVCNYRDVRFESIRLPGCPRGVNPVVSYAVALSCQCALCRRSTTDCGGPKDHPLTCDDPRFQDSSSSKAPPPSLPSPSRLPGPSDTPILPQDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13189 - protein, 127 aa, Artificial Sequence
  Description of Artificial Sequence: Synthetic polypeptide
  Synthetic construct
MDWTWRILFLVAAATGVHSDIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKR

SEQ ID NO: 13190 - protein, 107 aa, Mus musculus
DIVLTQSPSSMSLSLGDTVSITCHSSQDISNIGWLQQKPGKSFKGLIYHGTNLEDGVPSRFSGSGSGADYSLTISSLESEDFVDYYCVQYGQFPWTFGGGTKLEIKR

SEQ ID NO: 13191 - protein, 108 aa, Artificial Sequence
  Description of Artificial Sequence: Synthetic polypeptide
  Synthetic construct
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKR

SEQ ID NO: 13192 - protein, 108 aa, Mus musculus
DILMTQSPSSMSVSLGDTVSITCHSSQDINSNIGWLQQRPGKSFKGLIYHGTNLDDEVPSRFSGSGSGADYSLTISSLESEDFADYYCVQYAQFPWTFGGGTKLEIKR

SEQ ID NO: 13193 - protein, 107 aa, Artificial Sequence
  Description of Artificial Sequence: Synthetic polypeptide
  Synthetic construct
DILMTQSPSSMSVSLGDTVSITCHSSQDINSNIGWLQQRPGKSFKGLIYHGTNLDDEVPSRFSGSGSGTDYTLTISSLEPEDFATYYCVQYAQFPWTFGGGTKLEIK

SEQ ID NO: 13194 - protein, 107 aa, Mus musculus
DILMTQSPSSMSVSLGDTVSITCHSSQDINSNIGWLQQRPGKSFKGLIYHGTNLDDEVPSRFSGSGSGADYSLTISSLESEDFADYYCVQHAQFPWTFGGGTKLEIK

SEQ ID NO: 13195 - protein, 108 aa, Rattus norvegicus
DIQMTQSPSFLSASVGDRVTINCKASQNINNYLNWYQQKLGEAPKRLIYNTNNLQTGIPSRFSGSGSGTDYTLTISSLQPEDFATYFCLQHNSFPTFGAGTKLELKRT

SEQ ID NO: 13196 - protein, 108 aa, Artificial Sequence; identical to SEQ ID NO: 8767
  Description of Artificial Sequence: Synthetic polypeptide
  Synthetic (light-chain variable region of anti-EGFR antibody)

SEQ ID NO: 13197 - protein, 108 aa, Artificial Sequence
  Description of Artificial Sequence: Synthetic polypeptide
  anti-IGF-1R VL
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESK

SEQ ID NO: 13198 - protein, 108 aa, Artificial Sequence
  Description of Artificial Sequence: Synthetic polypeptide
  anti-IGF-1R VL
EIVLTQSPATLSLSPGERATLSCRASQSVSSYLAWYQQKPGQAPRLLIYDASNRATGIPARFSGSGSGTDFTLTISSLEPEDFAVYYCQQRSKWPPWTFGQGTKVEIK

SEQ ID NO: 13199 - protein, 107 aa, Artificial Sequence
  Description of Artificial Sequence: Synthetic polypeptide
  Humanized Cetuximab (Hu225) Light Chain Variable domain
DILLTQSPGTLSLSPGERATLSCRASQSIGTNIHWYQQKPGQAPRLLIKYASESISGIPDRFSGSGSGTDFTLTISRLEPEDFAVYYCQQNNNWPTTFGQGTKLEIK

SEQ ID NO: 13200 - protein, 107 aa, Artificial Sequence
  Description of Artificial Sequence: Synthetic polypeptide
  Variable LC D001W
WILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13201 - protein, 107 aa, Artificial Sequence
  Description of Artificial Sequence: Synthetic polypeptide
  Variable LC I002C
DCLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13202 - protein, 107 aa, Artificial Sequence
  Description of Artificial Sequence: Synthetic polypeptide
  Variable LC I002V
DVLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13203 - protein, 107 aa, Artificial Sequence
  Description of Artificial Sequence: Synthetic polypeptide
  Variable LC I002W
DWLLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13204 - protein, 107 aa, Artificial Sequence
  Description of Artificial Sequence: Synthetic polypeptide
  Variable LC L003D
DIDLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13205 - protein, 107 aa, Artificial Sequence
  Description of Artificial Sequence: Synthetic polypeptide
  Variable LC L003F
DIFLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13206 - protein, 107 aa, Artificial Sequence
  Description of Artificial Sequence: Synthetic polypeptide
  Variable LC L003G
DIGLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13207 - protein, 107 aa, Artificial Sequence
  Description of Artificial Sequence: Synthetic polypeptide
  Variable LC L003S
DISLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13208 - protein, 107 aa, Artificial Sequence
  Description of Artificial Sequence: Synthetic polypeptide
  Variable LC L003T
DITLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13209 - protein, 107 aa, Artificial Sequence
  Description of Artificial Sequence: Synthetic polypeptide
  Variable LC L003V
DIVLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13210 - protein, 107 aa, Artificial Sequence
  Description of Artificial Sequence: Synthetic polypeptide
  Variable LC L003W
DIWLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13211 - protein, 107 aa, Artificial Sequence
  Description of Artificial Sequence: Synthetic polypeptide
  Variable LC L003Y
DIYLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13212 - protein, 107 aa, Artificial Sequence
  Description of Artificial Sequence: Synthetic polypeptide
  Variable LC L003R
DIRLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13213 - protein, 107 aa, Artificial Sequence
  Description of Artificial Sequence: Synthetic polypeptide
  Variable LC L004C
DILCTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13214 - protein, 107 aa, Artificial Sequence
  Description of Artificial Sequence: Synthetic polypeptide
  Variable LC L004E
DILETQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13215 - protein, 107 aa, Artificial Sequence
  Description of Artificial Sequence: Synthetic polypeptide
  Variable LC L004F
DILFTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13216 - protein, 107 aa, Artificial Sequence
  Description of Artificial Sequence: Synthetic polypeptide
  Variable LC L004I
DILITQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13217 - protein, 107 aa, Artificial Sequence
  Description of Artificial Sequence: Synthetic polypeptide
  Variable LC L004P
DILPTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13218 - protein, 107 aa, Artificial Sequence
  Description of Artificial Sequence: Synthetic polypeptide
  Variable LC L004S
DILSTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13219 - protein, 107 aa, Artificial Sequence
  Description of Artificial Sequence: Synthetic polypeptide
  Variable LC L004T
DILTTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13220 - protein, 107 aa, Artificial Sequence
  Description of Artificial Sequence: Synthetic polypeptide
  Variable LC L004V
DILVTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13221 - protein, 107 aa, Artificial Sequence
  Description of Artificial Sequence: Synthetic polypeptide
  Variable LC L004W
DILWTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13222 - protein, 107 aa, Artificial Sequence
  Description of Artificial Sequence: Synthetic polypeptide
  Variable LC L004K
DILKTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13223 - protein, 107 aa, Artificial Sequence
  Description of Artificial Sequence: Synthetic polypeptide
  Variable LC L004H
DILHTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13224 - protein, 107 aa, Artificial Sequence
  Description of Artificial Sequence: Synthetic polypeptide
  Variable LC L004R
DILRTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13225 - protein, 107 aa, Artificial Sequence
  Description of Artificial Sequence: Synthetic polypeptide
  Variable LC T005A
DILLAQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13226 - protein, 107 aa, Artificial Sequence
  Description of Artificial Sequence: Synthetic polypeptide
  Variable LC T005C
DILLCQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13227 - protein, 107 aa, Artificial Sequence
  Description of Artificial Sequence: Synthetic polypeptide
  Variable LC T005D
DILLDQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13228 - protein, 107 aa, Artificial Sequence
  Description of Artificial Sequence: Synthetic polypeptide
  Variable LC T005E
DILLEQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13229 - protein, 107 aa, Artificial Sequence
  Description of Artificial Sequence: Synthetic polypeptide
  Variable LC T005F
DILLFQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13230 - protein, 107 aa, Artificial Sequence
  Description of Artificial Sequence: Synthetic polypeptide
  Variable LC T005G
DILLGQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13231 - protein, 107 aa, Artificial Sequence
  Description of Artificial Sequence: Synthetic polypeptide
  Variable LC T005N
DILLNQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13232 - protein, 107 aa, Artificial Sequence
  Description of Artificial Sequence: Synthetic polypeptide
  Variable LC T005S
DILLSQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13233 - protein, 107 aa, Artificial Sequence
  Description of Artificial Sequence: Synthetic polypeptide
  Variable LC T005W
DILLWQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13234 - protein, 107 aa, Artificial Sequence
  Description of Artificial Sequence: Synthetic polypeptide
  Variable LC T005L
DILLLQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13235 - protein, 107 aa, Artificial Sequence
  Description of Artificial Sequence: Synthetic polypeptide
  Variable LC T005K
DILLKQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13236 - protein, 107 aa, Artificial Sequence
  Description of Artificial Sequence: Synthetic polypeptide
  Variable LC T005H
DILLHQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13237 - protein, 107 aa, Artificial Sequence
  Description of Artificial Sequence: Synthetic polypeptide
  Variable LC T005R
DILLRQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13238 - protein, 107 aa, Artificial Sequence
  Description of Artificial Sequence: Synthetic polypeptide
  Variable LC R024A
DILLTQSPVILSVSPGERVSFSCAASQSIGTNIHWYQQRTNGSPRLLIKYASESISGIPSRFSGSGSGTDFTLSINSVESEDIADYYCQQNNNWPTTFGAGTKLELK

SEQ ID NO: 13239 - protein, 107 aa, Artificial Sequence
  Description of Artificial Sequence: Synthetic polypeptide
  Variable LC R024C
DILLTQSPVILSVSPGERVSFSCCASQSIGTNIHWYQQRTNGSPRLLIKYASESISGIPSRFSGSGSGTDFTLSINSVESEDIADYYCQQNNNWPTTFGAGTKLELK

SEQ ID NO: 13240 - protein, 107 aa, Artificial Sequence
  Description of Artificial Sequence: Synthetic polypeptide
  Variable LC R024F
DILLTQSPVILSVSPGERVSFSCFASQSIGTNIHWYQQRTNGSPRLLIKYASESISGIPSRFSGSGSGTDFTLSINSVESEDIADYYCQQNNNWPTTFGAGTKLELK

SEQ ID NO: 13241 - protein, 107 aa, Artificial Sequence
  Description of Artificial Sequence: Synthetic polypeptide
  Variable LC R024L
DILLTQSPVILSVSPGERVSFSCLASQSIGTNIHWYQQRTNGSPRLLIKYASESISGIPSRFSGSGSGTDFTLSINSVESEDIADYYCQQNNNWPTTFGAGTKLELK

SEQ ID NO: 13242 - protein, 107 aa, Artificial Sequence
  Description of Artificial Sequence: Synthetic polypeptide
  Variable LC R024M
DILLTQSPVILSVSPGERVSFSCMASQSIGTNIHWYQQRTNGSPRLLIKYASESISGIPSRFSGSGSGTDFTLSINSVESEDIADYYCQQNNNWPTTFGAGTKLELK

SEQ ID NO: 13243 - protein, 107 aa, Artificial Sequence
  Description of Artificial Sequence: Synthetic polypeptide
  Variable LC R024S
DILLTQSPVILSVSPGERVSFSCSASQSIGTNIHWYQQRTNGSPRLLIKYASESISGIPSRFSGSGSGTDFTLSINSVESEDIADYYCQQNNNWPTTFGAGTKLELK

SEQ ID NO: 13244 - protein, 107 aa, Artificial Sequence
  Description of Artificial Sequence: Synthetic polypeptide
  Variable LC R024W
DILLTQSPVILSVSPGERVSFSCWASQSIGTNIHWYQQRTNGSPRLLIKYASESISGIPSRFSGSGSGTDFTLSINSVESEDIADYYCQQNNNWPTTFGAGTKLELK

SEQ ID NO: 13245 - protein, 107 aa, Artificial Sequence
  Description of Artificial Sequence: Synthetic polypeptide
  Variable LC R024Y
DILLTQSPVILSVSPGERVSFSCYASQSIGTNIHWYQQRTNGSPRLLIKYASESISGIPSRFSGSGSGTDFTLSINSVESEDIADYYCQQNNNWPTTFGAGTKLELK

SEQ ID NO: 13246 - protein, 107 aa, Artificial Sequence
  Description of Artificial Sequence: Synthetic polypeptide
  Variable LC A025C
DILLTQSPVILSVSPGERVSFSCRCSQSIGTNIHWYQQRTNGSPRLLIKYASESISGIPSRFSGSGSGTDFTLSINSVESEDIADYYCQQNNNWPTTFGAGTKLELK

SEQ ID NO: 13247 - protein, 107 aa, Artificial Sequence
  Description of Artificial Sequence: Synthetic polypeptide
  Variable LC A025G
DILLTQSPVILSVSPGERVSFSCRGSQSIGTNIHWYQQRTNGSPRLLIKYASESISGIPSRFSGSGSGTDFTLSINSVESEDIADYYCQQNNNWPTTFGAGTKLELK

SEQ ID NO: 13248 - protein, 107 aa, Artificial Sequence
  Description of Artificial Sequence: Synthetic polypeptide
  Variable LC A025L
DILLTQSPVILSVSPGERVSFSCRLSQSIGTNIHWYQQRTNGSPRLLIKYASESISGIPSRFSGSGSGTDFTLSINSVESEDIADYYCQQNNNWPTTFGAGTKLELK

SEQ ID NO: 13249 - protein, 107 aa, Artificial Sequence
  Description of Artificial Sequence: Synthetic polypeptide
  Variable LC A025V
DILLTQSPVILSVSPGERVSFSCRVSQSIGTNIHWYQQRTNGSPRLLIKYASESISGIPSRFSGSGSGTDFTLSINSVESEDIADYYCQQNNNWPTTFGAGTKLELK

SEQ ID NO: 13250 - protein, 107 aa, Artificial Sequence
  Description of Artificial Sequence: Synthetic polypeptide
  Variable LC S026A
DILLTQSPVILSVSPGERVSFSCRAAQSIGTNIHWYQQRTNGSPRLLIKYASESISGIPSRFSGSGSGTDFTLSINSVESEDIADYYCQQNNNWPTTFGAGTKLELK

SEQ ID NO: 13251 - protein, 107 aa, Artificial Sequence
  Description of Artificial Sequence: Synthetic polypeptide
  Variable LC S026C
DILLTQSPVILSVSPGERVSFSCRACQSIGTNIHWYQQRTNGSPRLLIKYASESISGIPSRFSGSGSGTDFTLSINSVESEDIADYYCQQNNNWPTTFGAGTKLELK

SEQ ID NO: 13252 - protein, 107 aa, Artificial Sequence
  Description of Artificial Sequence: Synthetic polypeptide
  Variable LC S026D
DILLTQSPVILSVSPGERVSFSCRADQSIGTNIHWYQQRTNGSPRLLIKYASESISGIPSRFSGSGSGTDFTLSINSVESEDIADYYCQQNNNWPTTFGAGTKLELK

SEQ ID NO: 13253 - protein, 107 aa, Artificial Sequence
  Description of Artificial Sequence: Synthetic polypeptide
  Variable LC S026I
DILLTQSPVILSVSPGERVSFSCRAIQSIGTNIHWYQQRTNGSPRLLIKYASESISGIPSRFSGSGSGTDFTLSINSVESEDIADYYCQQNNNWPTTFGAGTKLELK

SEQ ID NO: 13254 - protein, 107 aa, Artificial Sequence
  Description of Artificial Sequence: Synthetic polypeptide
  Variable LC S026M
DILLTQSPVILSVSPGERVSFSCRAMQSIGTNIHWYQQRTNGSPRLLIKYASESISGIPSRFSGSGSGTDFTLSINSVESEDIADYYCQQNNNWPTTFGAGTKLELK

SEQ ID NO: 13255 - protein, 107 aa, Artificial Sequence
  Description of Artificial Sequence: Synthetic polypeptide
  Variable LC S026N
DILLTQSPVILSVSPGERVSFSCRANQSIGTNIHWYQQRTNGSPRLLIKYASESISGIPSRFSGSGSGTDFTLSINSVESEDIADYYCQQNNNWPTTFGAGTKLELK

SEQ ID NO: 13256 - protein, 107 aa, Artificial Sequence
  Description of Artificial Sequence: Synthetic polypeptide
  Variable LC S026V
DILLTQSPVILSVSPGERVSFSCRAVQSIGTNIHWYQQRTNGSPRLLIKYASESISGIPSRFSGSGSGTDFTLSINSVESEDIADYYCQQNNNWPTTFGAGTKLELK

SEQ ID NO: 13257 - protein, 107 aa, Artificial Sequence
  Description of Artificial Sequence: Synthetic polypeptide
  Variable LC S026W
DILLTQSPVILSVSPGERVSFSCRAWQSIGTNIHWYQQRTNGSPRLLIKYASESISGIPSRFSGSGSGTDFTLSINSVESEDIADYYCQQNNNWPTTFGAGTKLELK

SEQ ID NO: 13258 - protein, 107 aa, Artificial Sequence
  Description of Artificial Sequence: Synthetic polypeptide
  Variable LC S026L
DILLTQSPVILSVSPGERVSFSCRALQSIGTNIHWYQQRTNGSPRLLIKYASESISGIPSRFSGSGSGTDFTLSINSVESEDIADYYCQQNNNWPTTFGAGTKLELK

SEQ ID NO: 13259 - protein, 107 aa, Artificial Sequence
  Description of Artificial Sequence: Synthetic polypeptide
  Variable LC S026G
DILLTQSPVILSVSPGERVSFSCRAGQSIGTNIHWYQQRTNGSPRLLIKYASESISGIPSRFSGSGSGTDFTLSINSVESEDIADYYCQQNNNWPTTFGAGTKLELK

SEQ ID NO: 13260 - protein, 107 aa, Artificial Sequence
  Description of Artificial Sequence: Synthetic polypeptide
  Variable LC S026H
DILLTQSPVILSVSPGERVSFSCRAHQSIGTNIHWYQQRTNGSPRLLIKYASESISGIPSRFSGSGSGTDFTLSINSVESEDIADYYCQQNNNWPTTFGAGTKLELK

SEQ ID NO: 13261 - protein, 107 aa, Artificial Sequence
  Description of Artificial Sequence: Synthetic polypeptide
  Variable LC S026R
DILLTQSPVILSVSPGERVSFSCRARQSIGTNIHWYQQRTNGSPRLLIKYASESISGIPSRFSGSGSGTDFTLSINSVESEDIADYYCQQNNNWPTTFGAGTKLELK

SEQ ID NO: 13262 - protein, 107 aa, Artificial Sequence
  Description of Artificial Sequence: Synthetic polypeptide
  Variable LC Q027A
DILLTQSPVILSVSPGERVSFSCRASASIGTNIHWYQQRTNGSPRLLIKYASESISGIPSRFSGSGSGTDFTLSINSVESEDIADYYCQQNNNWPTTFGAGTKLELK

SEQ ID NO: 13263 - protein, 107 aa, Artificial Sequence
  Description of Artificial Sequence: Synthetic polypeptide
  Variable LC Q027D
DILLTQSPVILSVSPGERVSFSCRASDSIGTNIHWYQQRTNGSPRLLIKYASESISGIPSRFSGSGSGTDFTLSINSVESEDIADYYCQQNNNWPTTFGAGTKLELK

SEQ ID NO: 13264 - protein, 107 aa, Artificial Sequence
  Description of Artificial Sequence: Synthetic polypeptide
  Variable LC Q027E
DILLTQSPVILSVSPGERVSFSCRASESIGTNIHWYQQRTNGSPRLLIKYASESISGIPSRFSGSGSGTDFTLSINSVESEDIADYYCQQNNNWPTTFGAGTKLELK

SEQ ID NO: 13265 - protein, 107 aa, Artificial Sequence
  Description of Artificial Sequence: Synthetic polypeptide
  Variable LC Q027F
DILLTQSPVILSVSPGERVSFSCRASFSIGTNIHWYQQRTNGSPRLLIKYASESISGIPSRFSGSGSGTDFTLSINSVESEDIADYYCQQNNNWPTTFGAGTKLELK

SEQ ID NO: 13266 - protein, 107 aa, Artificial Sequence
  Description of Artificial Sequence: Synthetic polypeptide
  Variable LC Q027I
DILLTQSPVILSVSPGERVSFSCRASISIGTNIHWYQQRTNGSPRLLIKYASESISGIPSRFSGSGSGTDFTLSINSVESEDIADYYCQQNNNWPTTFGAGTKLELK

SEQ ID NO: 13267 - protein, 107 aa, Artificial Sequence
  Description of Artificial Sequence: Synthetic polypeptide
  Variable LC Q027M
DILLTQSPVILSVSPGERVSFSCRASMSIGTNIHWYQQRTNGSPRLLIKYASESISGIPSRFSGSGSGTDFTLSINSVESEDIADYYCQQNNNWPTTFGAGTKLELK

SEQ ID NO: 13268 - protein, 107 aa, Artificial Sequence
  Description of Artificial Sequence: Synthetic polypeptide
  Variable LC Q027N
DILLTQSPVILSVSPGERVSFSCRASNSIGTNIHWYQQRTNGSPRLLIKYASESISGIPSRFSGSGSGTDFTLSINSVESEDIADYYCQQNNNWPTTFGAGTKLELK

SEQ ID NO: 13269 - protein, 107 aa, Artificial Sequence
  Description of Artificial Sequence: Synthetic polypeptide
  Variable LC Q027P
DILLTQSPVILSVSPGERVSFSCRASPSIGTNIHWYQQRTNGSPRLLIKYASESISGIPSRFSGSGSGTDFTLSINSVESEDIADYYCQQNNNWPTTFGAGTKLELK

SEQ ID NO: 13270 - protein, 107 aa, Artificial Sequence
  Description of Artificial Sequence: Synthetic polypeptide
  Variable LC Q027T
DILLTQSPVILSVSPGERVSFSCRASTSIGTNIHWYQQRTNGSPRLLIKYASESISGIPSRFSGSGSGTDFTLSINSVESEDIADYYCQQNNNWPTTFGAGTKLELK

SEQ ID NO: 13271 - protein, 107 aa, Artificial Sequence
  Description of Artificial Sequence: Synthetic polypeptide
  Variable LC S028A
DILLTQSPVILSVSPGERVSFSCRASQAIGTNIHWYQQRTNGSPRLLIKYASESISGIPSRFSGSGSGTDFTLSINSVESEDIADYYCQQNNNWPTTFGAGTKLELK

SEQ ID NO: 13272 - protein, 107 aa, Artificial Sequence
  Description of Artificial Sequence: Synthetic polypeptide
  Variable LC S028D
DILLTQSPVILSVSPGERVSFSCRASQDIGTNIHWYQQRTNGSPRLLIKYASESISGIPSRFSGSGSGTDFTLSINSVESEDIADYYCQQNNNWPTTFGAGTKLELK

SEQ ID NO: 13273 - protein, 107 aa, Artificial Sequence
  Description of Artificial Sequence: Synthetic polypeptide
  Variable LC S028N
DILLTQSPVILSVSPGERVSFSCRASQNIGTNIHWYQQRTNGSPRLLIKYASESISGIPSRFSGSGSGTDFTLSINSVESEDIADYYCQQNNNWPTTFGAGTKLELK

SEQ ID NO: 13274 - protein, 107 aa, Artificial Sequence
  Description of Artificial Sequence: Synthetic polypeptide
  Variable LC S028Q
DILLTQSPVILSVSPGERVSFSCRASQQIGTNIHWYQQRTNGSPRLLIKYASESISGIPSRFSGSGSGTDFTLSINSVESEDIADYYCQQNNNWPTTFGAGTKLELK

SEQ ID NO: 13275 - protein, 107 aa, Artificial Sequence
  Description of Artificial Sequence: Synthetic polypeptide
  Variable LC S028L
DILLTQSPVILSVSPGERVSFSCRASQLIGTNIHWYQQRTNGSPRLLIKYASESISGIPSRFSGSGSGTDFTLSINSVESEDIADYYCQQNNNWPTTFGAGTKLELK

SEQ ID NO: 13276 - protein, 107 aa, Artificial Sequence
  Description of Artificial Sequence: Synthetic polypeptide
  Variable LC S028K
DILLTQSPVILSVSPGERVSFSCRASQKIGTNIHWYQQRTNGSPRLLIKYASESISGIPSRFSGSGSGTDFTLSINSVESEDIADYYCQQNNNWPTTFGAGTKLELK

SEQ ID NO: 13277 - protein, 107 aa, Artificial Sequence
  Description of Artificial Sequence: Synthetic polypeptide
  Variable LC S028H
DILLTQSPVILSVSPGERVSFSCRASQHIGTNIHWYQQRTNGSPRLLIKYASESISGIPSRFSGSGSGTDFTLSINSVESEDIADYYCQQNNNWPTTFGAGTKLELK

SEQ ID NO: 13278 - protein, 107 aa, Artificial Sequence
  Description of Artificial Sequence: Synthetic polypeptide
  Variable LC I029A
DILLTQSPVILSVSPGERVSFSCRASQSAGTNIHWYQQRTNGSPRLLIKYASESISGIPSRFSGSGSGTDFTLSINSVESEDIADYYCQQNNNWPTTFGAGTKLELK

SEQ ID NO: 13279 - protein, 107 aa, Artificial Sequence
  Description of Artificial Sequence: Synthetic polypeptide
  Variable LC I029E
DILLTQSPVILSVSPGERVSFSCRASQSEGTNIHWYQQRTNGSPRLLIKYASESISGIPSRFSGSGSGTDFTLSINSVESEDIADYYCQQNNNWPTTFGAGTKLELK

SEQ ID NO: 13280 - protein, 107 aa, Artificial Sequence
  Description of Artificial Sequence: Synthetic polypeptide
  Variable LC I029F
DILLTQSPVILSVSPGERVSFSCRASQSFGTNIHWYQQRTNGSPRLLIKYASESISGIPSRFSGSGSGTDFTLSINSVESEDIADYYCQQNNNWPTTFGAGTKLELK

SEQ ID NO: 13281 - protein, 107 aa, Artificial Sequence
  Description of Artificial Sequence: Synthetic polypeptide
  Variable LC I029S
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGAGTKLELK

SEQ ID NO: 13282 - protein, 107 aa, Artificial Sequence
  Description of Artificial Sequence: Synthetic polypeptide
  Variable LC I029T
DILLTQSPVILSVSPGERVSFSCRASQSTGTNIHWYQQRTNGSPRLLIKYASESISGIPSRFSGSGSGTDFTLSINSVESEDIADYYCQQNNNWPTTFGAGTKLELK

SEQ ID NO: 13283 - protein, 107 aa, Artificial Sequence
  Description of Artificial Sequence: Synthetic polypeptide
  Variable LC I029R
DILLTQSPVILSVSPGERVSFSCRASQSRGTNIHWYQQRTNGSPRLLIKYASESISGIPSRFSGSGSGTDFTLSINSVESEDIADYYCQQNNNWPTTFGAGTKLELK

SEQ ID NO: 13284 - protein, 107 aa, Artificial Sequence
  Description of Artificial Sequence: Synthetic polypeptide
  Variable LC G030A
DILLTQSPVILSVSPGERVSFSCRASQSIATNIHWYQQRTNGSPRLLIKYASESISGIPSRFSGSGSGTDFTLSINSVESEDIADYYCQQNNNWPTTFGAGTKLELK

SEQ ID NO: 13285 - protein, 107 aa, Artificial Sequence
  Description of Artificial Sequence: Synthetic polypeptide
  Variable LC G030E
DILLTQSPVILSVSPGERVSFSCRASQSIETNIHWYQQRTNGSPRLLIKYASESISGIPSRFSGSGSGTDFTLSINSVESEDIADYYCQQNNNWPTTFGAGTKLELK

SEQ ID NO: 13286 - protein, 107 aa, Artificial Sequence
  Description of Artificial Sequence: Synthetic polypeptide
  Variable LC G030F
DILLTQSPVILSVSPGERVSFSCRASQSIFTNIHWYQQRTNGSPRLLIKYASESISGIPSRFSGSGSGTDFTLSINSVESEDIADYYCQQNNNWPTTFGAGTKLELK

SEQ ID NO: 13287 - protein, 107 aa, Artificial Sequence
  Description of Artificial Sequence: Synthetic polypeptide
  Variable LC G030I
DILLTQSPVILSVSPGERVSFSCRASQSIITNIHWYQQRTNGSPRLLIKYASESISGIPSRFSGSGSGTDFTLSINSVESEDIADYYCQQNNNWPTTFGAGTKLELK

SEQ ID NO: 13288 - protein, 107 aa, Artificial Sequence
  Description of Artificial Sequence: Synthetic polypeptide
  Variable LC G030M
DILLTQSPVILSVSPGERVSFSCRASQSIMTNIHWYQQRTNGSPRLLIKYASESISGIPSRFSGSGSGTDFTLSINSVESEDIADYYCQQNNNWPTTFGAGTKLELK

SEQ ID NO: 13289 - protein, 107 aa, Artificial Sequence
  Description of Artificial Sequence: Synthetic polypeptide
  Variable LC G030P
DILLTQSPVILSVSPGERVSFSCRASQSIPTNIHWYQQRTNGSPRLLIKYASESISGIPSRFSGSGSGTDFTLSINSVESEDIADYYCQQNNNWPTTFGAGTKLELK

SEQ ID NO: 13290 - protein, 107 aa, Artificial Sequence
  Description of Artificial Sequence: Synthetic polypeptide
  Variable LC G030Q
DILLTQSPVILSVSPGERVSFSCRASQSIQTNIHWYQQRTNGSPRLLIKYASESISGIPSRFSGSGSGTDFTLSINSVESEDIADYYCQQNNNWPTTFGAGTKLELK

SEQ ID NO: 13291 - protein, 107 aa, Artificial Sequence
  Description of Artificial Sequence: Synthetic polypeptide
  Variable LC G030S
DILLTQSPVILSVSPGERVSFSCRASQSISTNIHWYQQRTNGSPRLLIKYASESISGIPSRFSGSGSGTDFTLSINSVESEDIADYYCQQNNNWPTTFGAGTKLELK

SEQ ID NO: 13292 - protein, 107 aa, Artificial Sequence
  Description of Artificial Sequence: Synthetic polypeptide
  Variable LC G030V
DILLTQSPVILSVSPGERVSFSCRASQSIVTNIHWYQQRTNGSPRLLIKYASESISGIPSRFSGSGSGTDFTLSINSVESEDIADYYCQQNNNWPTTFGAGTKLELK

SEQ ID NO: 13293 - protein, 107 aa, Artificial Sequence
  Description of Artificial Sequence: Synthetic polypeptide
  Variable LC G030Y
DILLTQSPVILSVSPGERVSFSCRASQSIYTNIHWYQQRTNGSPRLLIKYASESISGIPSRFSGSGSGTDFTLSINSVESEDIADYYCQQNNNWPTTFGAGTKLELK

SEQ ID NO: 13294 - protein, 107 aa, Artificial Sequence
  Description of Artificial Sequence: Synthetic polypeptide
  Variable LC G030L
DILLTQSPVILSVSPGERVSFSCRASQSILTNIHWYQQRTNGSPRLLIKYASESISGIPSRFSGSGSGTDFTLSINSVESEDIADYYCQQNNNWPTTFGAGTKLELK

SEQ ID NO: 13295 - protein, 107 aa, Artificial Sequence
  Description of Artificial Sequence: Synthetic polypeptide
  Variable LC G030K
DILLTQSPVILSVSPGERVSFSCRASQSIKTNIHWYQQRTNGSPRLLIKYASESISGIPSRFSGSGSGTDFTLSINSVESEDIADYYCQQNNNWPTTFGAGTKLELK

SEQ ID NO: 13296 - protein, 107 aa, Artificial Sequence
  Description of Artificial Sequence: Synthetic polypeptide
  Variable LC G030H
DILLTQSPVILSVSPGERVSFSCRASQSIHTNIHWYQQRTNGSPRLLIKYASESISGIPSRFSGSGSGTDFTLSINSVESEDIADYYCQQNNNWPTTFGAGTKLELK

SEQ ID NO: 13297 - protein, 107 aa, Artificial Sequence
  Description of Artificial Sequence: Synthetic polypeptide
  Variable LC G030R
DILLTQSPVILSVSPGERVSFSCRASQSIRTNIHWYQQRTNGSPRLLIKYASESISGIPSRFSGSGSGTDFTLSINSVESEDIADYYCQQNNNWPTTFGAGTKLELK

SEQ ID NO: 13298 - protein, 107 aa, Artificial Sequence
  Description of Artificial Sequence: Synthetic polypeptide
  Variable LC T031A
DILLTQSPVILSVSPGERVSFSCRASQSIGANIHWYQQRTNGSPRLLIKYASESISGIPSRFSGSGSGTDFTLSINSVESEDIADYYCQQNNNWPTTFGAGTKLELK

SEQ ID NO: 13299 - protein, 107 aa, Artificial Sequence
  Description of Artificial Sequence: Synthetic polypeptide
  Variable LC T031F
DILLTQSPVILSVSPGERVSFSCRASQSIGFNIHWYQQRTNGSPRLLIKYASESISGIPSRFSGSGSGTDFTLSINSVESEDIADYYCQQNNNWPTTFGAGTKLELK

SEQ ID NO: 13300 - protein, 107 aa, Artificial Sequence
  Description of Artificial Sequence: Synthetic polypeptide
  Variable LC T031G
DILLTQSPVILSVSPGERVSFSCRASQSIGGNIHWYQQRTNGSPRLLIKYASESISGIPSRFSGSGSGTDFTLSINSVESEDIADYYCQQNNNWPTTFGAGTKLELK

SEQ ID NO: 13301 - protein, 107 aa, Artificial Sequence
  Description of Artificial Sequence: Synthetic polypeptide
  Variable LC T031M
DILLTQSPVILSVSPGERVSFSCRASQSIGMNIHWYQQRTNGSPRLLIKYASESISGIPSRFSGSGSGTDFTLSINSVESEDIADYYCQQNNNWPTTFGAGTKLELK

SEQ ID NO: 13302 - protein, 107 aa, Artificial Sequence
  Description of Artificial Sequence: Synthetic polypeptide
  Variable LC T031S
DILLTQSPVILSVSPGERVSFSCRASQSIGSNIHWYQQRTNGSPRLLIKYASESISGIPSRFSGSGSGTDFTLSINSVESEDIADYYCQQNNNWPTTFGAGTKLELK

SEQ ID NO: 13303 - protein, 107 aa, Artificial Sequence
  Description of Artificial Sequence: Synthetic polypeptide
  Variable LC T031V
DILLTQSPVILSVSPGERVSFSCRASQSIGVNIHWYQQRTNGSPRLLIKYASESISGIPSRFSGSGSGTDFTLSINSVESEDIADYYCQQNNNWPTTFGAGTKLELK

SEQ ID NO: 13304 - protein, 107 aa, Artificial Sequence
  Description of Artificial Sequence: Synthetic polypeptide
  Variable LC T031W
DILLTQSPVILSVSPGERVSFSCRASQSIGWNIHWYQQRTNGSPRLLIKYASESISGIPSRFSGSGSGTDFTLSINSVESEDIADYYCQQNNNWPTTFGAGTKLELK

SEQ ID NO: 13305 - protein, 107 aa, Artificial Sequence
  Description of Artificial Sequence: Synthetic polypeptide
  Variable LC T031L
DILLTQSPVILSVSPGERVSFSCRASQSIGLNIHWYQQRTNGSPRLLIKYASESISGIPSRFSGSGSGTDFTLSINSVESEDIADYYCQQNNNWPTTFGAGTKLELK

SEQ ID NO: 13306 - protein, 107 aa, Artificial Sequence
  Description of Artificial Sequence: Synthetic polypeptide
  Variable LC T031K
DILLTQSPVILSVSPGERVSFSCRASQSIGKNIHWYQQRTNGSPRLLIKYASESISGIPSRFSGSGSGTDFTLSINSVESEDIADYYCQQNNNWPTTFGAGTKLELK

SEQ ID NO: 13307 - protein, 107 aa, Artificial Sequence
  Description of Artificial Sequence: Synthetic polypeptide
  Variable LC T031H
DILLTQSPVILSVSPGERVSFSCRASQSIGHNIHWYQQRTNGSPRLLIKYASESISGIPSRFSGSGSGTDFTLSINSVESEDIADYYCQQNNNWPTTFGAGTKLELK

SEQ ID NO: 13308 - protein, 107 aa, Artificial Sequence
  Description of Artificial Sequence: Synthetic polypeptide
  Variable LC N032G
DILLTQSPVILSVSPGERVSFSCRASQSIGTGIHWYQQRTNGSPRLLIKYASESISGIPSRFSGSGSGTDFTLSINSVESEDIADYYCQQNNNWPTTFGAGTKLELK

SEQ ID NO: 13309 - protein, 107 aa, Artificial Sequence
  Description of Artificial Sequence: Synthetic polypeptide
  Variable LC I033F
DILLTQSPVILSVSPGERVSFSCRASQSIGTNFHWYQQRTNGSPRLLIKYASESISGIPSRFSGSGSGTDFTLSINSVESEDIADYYCQQNNNWPTTFGAGTKLELK

SEQ ID NO: 13310 - protein, 107 aa, Artificial Sequence
  Description of Artificial Sequence: Synthetic polypeptide
  Variable LC I033G
DILLTQSPVILSVSPGERVSFSCRASQSIGTNGHWYQQRTNGSPRLLIKYASESISGIPSRFSGSGSGTDFTLSINSVESEDIADYYCQQNNNWPTTFGAGTKLELK

SEQ ID NO: 13311 - protein, 107 aa, Artificial Sequence
  Description of Artificial Sequence: Synthetic polypeptide
  Variable LC I033M
DILLTQSPVILSVSPGERVSFSCRASQSIGTNMHWYQQRTNGSPRLLIKYASESISGIPSRFSGSGSGTDFTLSINSVESEDIADYYCQQNNNWPTTFGAGTKLELK

SEQ ID NO: 13312 - protein, 107 aa, Artificial Sequence
  Description of Artificial Sequence: Synthetic polypeptide
  Variable LC I033T
DILLTQSPVILSVSPGERVSFSCRASQSIGTNTHWYQQRTNGSPRLLIKYASESISGIPSRFSGSGSGTDFTLSINSVESEDIADYYCQQNNNWPTTFGAGTKLELK

SEQ ID NO: 13313 - protein, 107 aa, Artificial Sequence
  Description of Artificial Sequence: Synthetic polypeptide
  Variable LC I033V
DILLTQSPVILSVSPGERVSFSCRASQSIGTNVHWYQQRTNGSPRLLIKYASESISGIPSRFSGSGSGTDFTLSINSVESEDIADYYCQQNNNWPTTFGAGTKLELK

SEQ ID NO: 13314 - protein, 107 aa, Artificial Sequence
  Description of Artificial Sequence: Synthetic polypeptide
  Variable LC I033H
DILLTQSPVILSVSPGERVSFSCRASQSIGTNHHWYQQRTNGSPRLLIKYASESISGIPSRFSGSGSGTDFTLSINSVESEDIADYYCQQNNNWPTTFGAGTKLELK

SEQ ID NO: 13315 - protein, 107 aa, Artificial Sequence
  Description of Artificial Sequence: Synthetic polypeptide
  Variable LC I048M
DILLTQSPVILSVSPGERVSFSCRASQSIGTNIHWYQQRTNGSPRLLMKYASESISGIPSRFSGSGSGTDFTLSINSVESEDIADYYCQQNNNWPTTFGAGTKLELK

SEQ ID NO: 13316 - protein, 107 aa, Artificial Sequence
  Description of Artificial Sequence: Synthetic polypeptide
  Variable LC I048S
DILLTQSPVILSVSPGERVSFSCRASQSIGTNIHWYQQRTNGSPRLLSKYASESISGIPSRFSGSGSGTDFTLSINSVESEDIADYYCQQNNNWPTTFGAGTKLELK

SEQ ID NO: 13317 - protein, 107 aa, Artificial Sequence
  Description of Artificial Sequence: Synthetic polypeptide
  Variable LC I048L
DILLTQSPVILSVSPGERVSFSCRASQSIGTNIHWYQQRTNGSPRLLLKYASESISGIPSRFSGSGSGTDFTLSINSVESEDIADYYCQQNNNWPTTFGAGTKLELK

SEQ ID NO: 13318 - protein, 107 aa, Artificial Sequence
  Description of Artificial Sequence: Synthetic polypeptide
  Variable LC I048K
DILLTQSPVILSVSPGERVSFSCRASQSIGTNIHWYQQRTNGSPRLLKKYASESISGIPSRFSGSGSGTDFTLSINSVESEDIADYYCQQNNNWPTTFGAGTKLELK

SEQ ID NO: 13319 - protein, 107 aa, Artificial Sequence
  Description of Artificial Sequence: Synthetic polypeptide
  Variable LC K049A
DILLTQSPVILSVSPGERVSFSCRASQSIGTNIHWYQQRTNGSPRLLIAYASESISGIPSRFSGSGSGTDFTLSINSVESEDIADYYCQQNNNWPTTFGAGTKLELK

SEQ ID NO: 13320 - protein, 107 aa, Artificial Sequence
  Description of Artificial Sequence: Synthetic polypeptide
  Variable LC K049E
DILLTQSPVILSVSPGERVSFSCRASQSIGTNIHWYQQRTNGSPRLLIEYASESISGIPSRFSGSGSGTDFTLSINSVESEDIADYYCQQNNNWPTTFGAGTKLELK

SEQ ID NO: 13321 - protein, 107 aa, Artificial Sequence
  Description of Artificial Sequence: Synthetic polypeptide
  Variable LC K049F
DILLTQSPVILSVSPGERVSFSCRASQSIGTNIHWYQQRTNGSPRLLIFYASESISGIPSRFSGSGSGTDFTLSINSVESEDIADYYCQQNNNWPTTFGAGTKLELK

SEQ ID NO: 13322 - protein, 107 aa, Artificial Sequence
  Description of Artificial Sequence: Synthetic polypeptide
  Variable LC K049G
DILLTQSPVILSVSPGERVSFSCRASQSIGTNIHWYQQRTNGSPRLLIGYASESISGIPSRFSGSGSGTDFTLSINSVESEDIADYYCQQNNNWPTTFGAGTKLELK

SEQ ID NO: 13323 - protein, 107 aa, Artificial Sequence
  Description of Artificial Sequence: Synthetic polypeptide
  Variable LC K049N
DILLTQSPVILSVSPGERVSFSCRASQSIGTNIHWYQQRTNGSPRLLINYASESISGIPSRFSGSGSGTDFTLSINSVESEDIADYYCQQNNNWPTTFGAGTKLELK

SEQ ID NO: 13324 - protein, 107 aa, Artificial Sequence
  Description of Artificial Sequence: Synthetic polypeptide
  Variable LC K049Q
DILLTQSPVILSVSPGERVSFSCRASQSIGTNIHWYQQRTNGSPRLLIQYASESISGIPSRFSGSGSGTDFTLSINSVESEDIADYYCQQNNNWPTTFGAGTKLELK

SEQ ID NO: 13325 - protein, 107 aa, Artificial Sequence
  Description of Artificial Sequence: Synthetic polypeptide
  Variable LC K049S
DILLTQSPVILSVSPGERVSFSCRASQSIGTNIHWYQQRTNGSPRLLISYASESISGIPSRFSGSGSGTDFTLSINSVESEDIADYYCQQNNNWPTTFGAGTKLELK

SEQ ID NO: 13326 - protein, 107 aa, Artificial Sequence
  Description of Artificial Sequence: Synthetic polypeptide
  Variable LC K049T
DILLTQSPVILSVSPGERVSFSCRASQSIGTNIHWYQQRTNGSPRLLITYASESISGIPSRFSGSGSGTDFTLSINSVESEDIADYYCQQNNNWPTTFGAGTKLELK

SEQ ID NO: 13327 - protein, 107 aa, Artificial Sequence
  Description of Artificial Sequence: Synthetic polypeptide
  Variable LC K049V
DILLTQSPVILSVSPGERVSFSCRASQSIGTNIHWYQQRTNGSPRLLIVYASESISGIPSRFSGSGSGTDFTLSINSVESEDIADYYCQQNNNWPTTFGAGTKLELK

SEQ ID NO: 13328 - protein, 107 aa, Artificial Sequence
  Description of Artificial Sequence: Synthetic polypeptide
  Variable LC K049Y
DILLTQSPVILSVSPGERVSFSCRASQSIGTNIHWYQQRTNGSPRLLIYYASESISGIPSRFSGSGSGTDFTLSINSVESEDIADYYCQQNNNWPTTFGAGTKLELK

SEQ ID NO: 13329 - protein, 107 aa, Artificial Sequence
  Description of Artificial Sequence: Synthetic polypeptide
  Variable LC K049L
DILLTQSPVILSVSPGERVSFSCRASQSIGTNIHWYQQRTNGSPRLLILYASESISGIPSRFSGSGSGTDFTLSINSVESEDIADYYCQQNNNWPTTFGAGTKLELK

SEQ ID NO: 13330 - protein, 107 aa, Artificial Sequence
  Description of Artificial Sequence: Synthetic polypeptide
  Variable LC K049H
DILLTQSPVILSVSPGERVSFSCRASQSIGTNIHWYQQRTNGSPRLLIHYASESISGIPSRFSGSGSGTDFTLSINSVESEDIADYYCQQNNNWPTTFGAGTKLELK

SEQ ID NO: 13331 - protein, 107 aa, Artificial Sequence
  Description of Artificial Sequence: Synthetic polypeptide
  Variable LC K049R
DILLTQSPVILSVSPGERVSFSCRASQSIGTNIHWYQQRTNGSPRLLIRYASESISGIPSRFSGSGSGTDFTLSINSVESEDIADYYCQQNNNWPTTFGAGTKLELK

SEQ ID NO: 13332 - protein, 107 aa, Artificial Sequence
  Description of Artificial Sequence: Synthetic polypeptide
  Variable LC A051T
DILLTQSPVILSVSPGERVSFSCRASQSIGTNIHWYQQRTNGSPRLLIKYTSESISGIPSRFSGSGSGTDFTLSINSVESEDIADYYCQQNNNWPTTFGAGTKLELK

SEQ ID NO: 13333 - protein, 107 aa, Artificial Sequence
  Description of Artificial Sequence: Synthetic polypeptide
  Variable LC A051L
DILLTQSPVILSVSPGERVSFSCRASQSIGTNIHWYQQRTNGSPRLLIKYLSESISGIPSRFSGSGSGTDFTLSINSVESEDIADYYCQQNNNWPTTFGAGTKLELK

SEQ ID NO: 13334 - protein, 107 aa, Artificial Sequence
  Description of Artificial Sequence: Synthetic polypeptide
  Variable LC S052A
DILLTQSPVILSVSPGERVSFSCRASQSIGTNIHWYQQRTNGSPRLLIKYAAESISGIPSRFSGSGSGTDFTLSINSVESEDIADYYCQQNNNWPTTFGAGTKLELK

SEQ ID NO: 13335 - protein, 107 aa, Artificial Sequence
  Description of Artificial Sequence: Synthetic polypeptide
  Variable LC S052C
DILLTQSPVILSVSPGERVSFSCRASQSIGTNIHWYQQRTNGSPRLLIKYACESISGIPSRFSGSGSGTDFTLSINSVESEDIADYYCQQNNNWPTTFGAGTKLELK

SEQ ID NO: 13336 - protein, 107 aa, Artificial Sequence
  Description of Artificial Sequence: Synthetic polypeptide
  Variable LC S052D
DILLTQSPVILSVSPGERVSFSCRASQSIGTNIHWYQQRTNGSPRLLIKYADESISGIPSRFSGSGSGTDFTLSINSVESEDIADYYCQQNNNWPTTFGAGTKLELK

SEQ ID NO: 13337 - protein, 107 aa, Artificial Sequence
  Description of Artificial Sequence: Synthetic polypeptide
  Variable LC S052E
DILLTQSPVILSVSPGERVSFSCRASQSIGTNIHWYQQRTNGSPRLLIKYAEESISGIPSRFSGSGSGTDFTLSINSVESEDIADYYCQQNNNWPTTFGAGTKLELK

SEQ ID NO: 13338 - protein, 107 aa, Artificial Sequence
  Description of Artificial Sequence: Synthetic polypeptide
  Variable LC S052G
DILLTQSPVILSVSPGERVSFSCRASQSIGTNIHWYQQRTNGSPRLLIKYAGESISGIPSRFSGSGSGTDFTLSINSVESEDIADYYCQQNNNWPTTFGAGTKLELK

SEQ ID NO: 13339 - protein, 107 aa, Artificial Sequence
  Description of Artificial Sequence: Synthetic polypeptide
  Variable LC S052I
DILLTQSPVILSVSPGERVSFSCRASQSIGTNIHWYQQRTNGSPRLLIKYAIESISGIPSRFSGSGSGTDFTLSINSVESEDIADYYCQQNNNWPTTFGAGTKLELK

SEQ ID NO: 13340 - protein, 107 aa, Artificial Sequence
  Description of Artificial Sequence: Synthetic polypeptide
  Variable LC S052M
DILLTQSPVILSVSPGERVSFSCRASQSIGTNIHWYQQRTNGSPRLLIKYAMESISGIPSRFSGSGSGTDFTLSINSVESEDIADYYCQQNNNWPTTFGAGTKLELK

SEQ ID NO: 13341 - protein, 107 aa, Artificial Sequence
  Description of Artificial Sequence: Synthetic polypeptide
  Variable LC S052Q
DILLTQSPVILSVSPGERVSFSCRASQSIGTNIHWYQQRTNGSPRLLIKYAQESISGIPSRFSGSGSGTDFTLSINSVESEDIADYYCQQNNNWPTTFGAGTKLELK

SEQ ID NO: 13342 - protein, 107 aa, Artificial Sequence
  Description of Artificial Sequence: Synthetic polypeptide
  Variable LC S052V
DILLTQSPVILSVSPGERVSFSCRASQSIGTNIHWYQQRTNGSPRLLIKYAVESISGIPSRFSGSGSGTDFTLSINSVESEDIADYYCQQNNNWPTTFGAGTKLELK

SEQ ID NO: 13343 - protein, 107 aa, Artificial Sequence
  Description of Artificial Sequence: Synthetic polypeptide
  Variable LC S052W
DILLTQSPVILSVSPGERVSFSCRASQSIGTNIHWYQQRTNGSPRLLIKYAWESISGIPSRFSGSGSGTDFTLSINSVESEDIADYYCQQNNNWPTTFGAGTKLELK

SEQ ID NO: 13344 - protein, 107 aa, Artificial Sequence
  Description of Artificial Sequence: Synthetic polypeptide
  Variable LC S052R
DILLTQSPVILSVSPGERVSFSCRASQSIGTNIHWYQQRTNGSPRLLIKYARESISGIPSRFSGSGSGTDFTLSINSVESEDIADYYCQQNNNWPTTFGAGTKLELK

SEQ ID NO: 13345 - protein, 107 aa, Artificial Sequence
  Description of Artificial Sequence: Synthetic polypeptide
  Variable LC S052K
DILLTQSPVILSVSPGERVSFSCRASQSIGTNIHWYQQRTNGSPRLLIKYAKESISGIPSRFSGSGSGTDFTLSINSVESEDIADYYCQQNNNWPTTFGAGTKLELK

SEQ ID NO: 13346 - protein, 107 aa, Artificial Sequence
  Description of Artificial Sequence: Synthetic polypeptide
  Variable LC E053G
DILLTQSPVILSVSPGERVSFSCRASQSIGTNIHWYQQRTNGSPRLLIKYASGSISGIPSRFSGSGSGTDFTLSINSVESEDIADYYCQQNNNWPTTFGAGTKLELK

SEQ ID NO: 13347 - protein, 107 aa, Artificial Sequence
  Description of Artificial Sequence: Synthetic polypeptide
  Variable LC S054M
DILLTQSPVILSVSPGERVSFSCRASQSIGTNIHWYQQRTNGSPRLLIKYASEMISGIPSRFSGSGSGTDFTLSINSVESEDIADYYCQQNNNWPTTFGAGTKLELK

SEQ ID NO: 13348 - protein, 107 aa, Artificial Sequence
  Description of Artificial Sequence: Synthetic polypeptide
  Variable LC I055A
DILLTQSPVILSVSPGERVSFSCRASQSIGTNIHWYQQRTNGSPRLLIKYASESASGIPSRFSGSGSGTDFTLSINSVESEDIADYYCQQNNNWPTTFGAGTKLELK

SEQ ID NO: 13349 - protein, 107 aa, Artificial Sequence
  Description of Artificial Sequence: Synthetic polypeptide
  Variable LC I055F
DILLTQSPVILSVSPGERVSFSCRASQSIGTNIHWYQQRTNGSPRLLIKYASESFSGIPSRFSGSGSGTDFTLSINSVESEDIADYYCQQNNNWPTTFGAGTKLELK

SEQ ID NO: 13350 - protein, 107 aa, Artificial Sequence
  Description of Artificial Sequence: Synthetic polypeptide
  Variable LC S056G
DILLTQSPVILSVSPGERVSFSCRASQSIGTNIHWYQQRTNGSPRLLIKYASESIGGIPSRFSGSGSGTDFTLSINSVESEDIADYYCQQNNNWPTTFGAGTKLELK

SEQ ID NO: 13351 - protein, 107 aa, Artificial Sequence
  Description of Artificial Sequence: Synthetic polypeptide
  Variable LC S056L
DILLTQSPVILSVSPGERVSFSCRASQSIGTNIHWYQQRTNGSPRLLIKYASESILGIPSRFSGSGSGTDFTLSINSVESEDIADYYCQQNNNWPTTFGAGTKLELK

SEQ ID NO: 13352 - protein, 107 aa, Artificial Sequence
  Description of Artificial Sequence: Synthetic polypeptide
  Variable LC S056A
DILLTQSPVILSVSPGERVSFSCRASQSIGTNIHWYQQRTNGSPRLLIKYASESIAGIPSRFSGSGSGTDFTLSINSVESEDIADYYCQQNNNWPTTFGAGTKLELK

SEQ ID NO: 13353 - protein, 107 aa, Artificial Sequence
  Description of Artificial Sequence: Synthetic polypeptide
  Variable LC S056C
DILLTQSPVILSVSPGERVSFSCRASQSIGTNIHWYQQRTNGSPRLLIKYASESICGIPSRFSGSGSGTDFTLSINSVESEDIADYYCQQNNNWPTTFGAGTKLELK

SEQ ID NO: 13354 - protein, 107 aa, Artificial Sequence
  Description of Artificial Sequence: Synthetic polypeptide
  Variable LC S056D
DILLTQSPVILSVSPGERVSFSCRASQSIGTNIHWYQQRTNGSPRLLIKYASESIDGIPSRFSGSGSGTDFTLSINSVESEDIADYYCQQNNNWPTTFGAGTKLELK

SEQ ID NO: 13355 - protein, 107 aa, Artificial Sequence
  Description of Artificial Sequence: Synthetic polypeptide
  Variable LC S056E
DILLTQSPVILSVSPGERVSFSCRASQSIGTNIHWYQQRTNGSPRLLIKYASESIEGIPSRFSGSGSGTDFTLSINSVESEDIADYYCQQNNNWPTTFGAGTKLELK

SEQ ID NO: 13356 - protein, 107 aa, Artificial Sequence
  Description of Artificial Sequence: Synthetic polypeptide
  Variable LC S056F
DILLTQSPVILSVSPGERVSFSCRASQSIGTNIHWYQQRTNGSPRLLIKYASESIFGIPSRFSGSGSGTDFTLSINSVESEDIADYYCQQNNNWPTTFGAGTKLELK

SEQ ID NO: 13357 - protein, 107 aa, Artificial Sequence
  Description of Artificial Sequence: Synthetic polypeptide
  Variable LC S056N
DILLTQSPVILSVSPGERVSFSCRASQSIGTNIHWYQQRTNGSPRLLIKYASESINGIPSRFSGSGSGTDFTLSINSVESEDIADYYCQQNNNWPTTFGAGTKLELK

SEQ ID NO: 13358 - protein, 107 aa, Artificial Sequence
  Description of Artificial Sequence: Synthetic polypeptide
  Variable LC S056P
DILLTQSPVILSVSPGERVSFSCRASQSIGTNIHWYQQRTNGSPRLLIKYASESIPGIPSRFSGSGSGTDFTLSINSVESEDIADYYCQQNNNWPTTFGAGTKLELK

SEQ ID NO: 13359 - protein, 107 aa, Artificial Sequence
  Description of Artificial Sequence: Synthetic polypeptide
  Variable LC S056Q
DILLTQSPVILSVSPGERVSFSCRASQSIGTNIHWYQQRTNGSPRLLIKYASESIQGIPSRFSGSGSGTDFTLSINSVESEDIADYYCQQNNNWPTTFGAGTKLELK

SEQ ID NO: 13360 - protein, 107 aa, Artificial Sequence
  Description of Artificial Sequence: Synthetic polypeptide
  Variable LC S056V
DILLTQSPVILSVSPGERVSFSCRASQSIGTNIHWYQQRTNGSPRLLIKYASESIVGIPSRFSGSGSGTDFTLSINSVESEDIADYYCQQNNNWPTTFGAGTKLELK

SEQ ID NO: 13361 - protein, 107 aa, Artificial Sequence
  Description of Artificial Sequence: Synthetic polypeptide
  Variable LC S056W
DILLTQSPVILSVSPGERVSFSCRASQSIGTNIHWYQQRTNGSPRLLIKYASESIWGIPSRFSGSGSGTDFTLSINSVESEDIADYYCQQNNNWPTTFGAGTKLELK

SEQ ID NO: 13362 - protein, 107 aa, Artificial Sequence
  Description of Artificial Sequence: Synthetic polypeptide
  Variable LC S056H
DILLTQSPVILSVSPGERVSFSCRASQSIGTNIHWYQQRTNGSPRLLIKYASESIHGIPSRFSGSGSGTDFTLSINSVESEDIADYYCQQNNNWPTTFGAGTKLELK

SEQ ID NO: 13363 - protein, 107 aa, Artificial Sequence
  Description of Artificial Sequence: Synthetic polypeptide
  Variable LC S056R
DILLTQSPVILSVSPGERVSFSCRASQSIGTNIHWYQQRTNGSPRLLIKYASESIRGIPSRFSGSGSGTDFTLSINSVESEDIADYYCQQNNNWPTTFGAGTKLELK

SEQ ID NO: 13364 - protein, 107 aa, Artificial Sequence
  Description of Artificial Sequence: Synthetic polypeptide
  Variable LC S056K
DILLTQSPVILSVSPGERVSFSCRASQSIGTNIHWYQQRTNGSPRLLIKYASESIKGIPSRFSGSGSGTDFTLSINSVESEDIADYYCQQNNNWPTTFGAGTKLELK

SEQ ID NO: 13365 - protein, 107 aa, Artificial Sequence
  Description of Artificial Sequence: Synthetic polypeptide
  Variable LC Y086F
DILLTQSPVILSVSPGERVSFSCRASQSIGTNIHWYQQRTNGSPRLLIKYASESISGIPSRFSGSGSGTDFTLSINSVESEDIADFYCQQNNNWPTTFGAGTKLELK

SEQ ID NO: 13366 - protein, 107 aa, Artificial Sequence
  Description of Artificial Sequence: Synthetic polypeptide
  Variable LC Y086M
DILLTQSPVILSVSPGERVSFSCRASQSIGTNIHWYQQRTNGSPRLLIKYASESISGIPSRFSGSGSGTDFTLSINSVESEDIADMYCQQNNNWPTTFGAGTKLELK

SEQ ID NO: 13367 - protein, 107 aa, Artificial Sequence
  Description of Artificial Sequence: Synthetic polypeptide
  Variable LC Y086H
DILLTQSPVILSVSPGERVSFSCRASQSIGTNIHWYQQRTNGSPRLLIKYASESISGIPSRFSGSGSGTDFTLSINSVESEDIADHYCQQNNNWPTTFGAGTKLELK

SEQ ID NO: 13368 - protein, 107 aa, Artificial Sequence
  Description of Artificial Sequence: Synthetic polypeptide
  Variable LC Y087L
DILLTQSPVILSVSPGERVSFSCRASQSIGTNIHWYQQRTNGSPRLLIKYASESISGIPSRFSGSGSGTDFTLSINSVESEDIADYLCQQNNNWPTTFGAGTKLELK

SEQ ID NO: 13369 - protein, 107 aa, Artificial Sequence
  Description of Artificial Sequence: Synthetic polypeptide
  Variable LC Y087C
DILLTQSPVILSVSPGERVSFSCRASQSIGTNIHWYQQRTNGSPRLLIKYASESISGIPSRFSGSGSGTDFTLSINSVESEDIADYCCQQNNNWPTTFGAGTKLELK

SEQ ID NO: 13370 - protein, 107 aa, Artificial Sequence
  Description of Artificial Sequence: Synthetic polypeptide
  Variable LC Y087D
DILLTQSPVILSVSPGERVSFSCRASQSIGTNIHWYQQRTNGSPRLLIKYASESISGIPSRFSGSGSGTDFTLSINSVESEDIADYDCQQNNNWPTTFGAGTKLELK

SEQ ID NO: 13371 - protein, 107 aa, Artificial Sequence
  Description of Artificial Sequence: Synthetic polypeptide
  Variable LC Y087F
DILLTQSPVILSVSPGERVSFSCRASQSIGTNIHWYQQRTNGSPRLLIKYASESISGIPSRFSGSGSGTDFTLSINSVESEDIADYFCQQNNNWPTTFGAGTKLELK

SEQ ID NO: 13372 - protein, 107 aa, Artificial Sequence
  Description of Artificial Sequence: Synthetic polypeptide
  Variable LC Y087G
DILLTQSPVILSVSPGERVSFSCRASQSIGTNIHWYQQRTNGSPRLLIKYASESISGIPSRFSGSGSGTDFTLSINSVESEDIADYGCQQNNNWPTTFGAGTKLELK

SEQ ID NO: 13373 - protein, 107 aa, Artificial Sequence
  Description of Artificial Sequence: Synthetic polypeptide
  Variable LC Y087I
DILLTQSPVILSVSPGERVSFSCRASQSIGTNIHWYQQRTNGSPRLLIKYASESISGIPSRFSGSGSGTDFTLSINSVESEDIADYICQQNNNWPTTFGAGTKLELK

SEQ ID NO: 13374 - protein, 107 aa, Artificial Sequence
  Description of Artificial Sequence: Synthetic polypeptide
  Variable LC Y087N
DILLTQSPVILSVSPGERVSFSCRASQSIGTNIHWYQQRTNGSPRLLIKYASESISGIPSRFSGSGSGTDFTLSINSVESEDIADYNCQQNNNWPTTFGAGTKLELK

SEQ ID NO: 13375 - protein, 107 aa, Artificial Sequence
  Description of Artificial Sequence: Synthetic polypeptide
  Variable LC Y087P
DILLTQSPVILSVSPGERVSFSCRASQSIGTNIHWYQQRTNGSPRLLIKYASESISGIPSRFSGSGSGTDFTLSINSVESEDIADYPCQQNNNWPTTFGAGTKLELK

SEQ ID NO: 13376 - protein, 107 aa, Artificial Sequence
  Description of Artificial Sequence: Synthetic polypeptide
  Variable LC Y087S
DILLTQSPVILSVSPGERVSFSCRASQSIGTNIHWYQQRTNGSPRLLIKYASESISGIPSRFSGSGSGTDFTLSINSVESEDIADYSCQQNNNWPTTFGAGTKLELK

SEQ ID NO: 13377 - protein, 107 aa, Artificial Sequence
  Description of Artificial Sequence: Synthetic polypeptide
  Variable LC Y087T
DILLTQSPVILSVSPGERVSFSCRASQSIGTNIHWYQQRTNGSPRLLIKYASESISGIPSRFSGSGSGTDFTLSINSVESEDIADYTCQQNNNWPTTFGAGTKLELK

SEQ ID NO: 13378 - protein, 107 aa, Artificial Sequence
  Description of Artificial Sequence: Synthetic polypeptide
  Variable LC Y087V
DILLTQSPVILSVSPGERVSFSCRASQSIGTNIHWYQQRTNGSPRLLIKYASESISGIPSRFSGSGSGTDFTLSINSVESEDIADYVCQQNNNWPTTFGAGTKLELK

SEQ ID NO: 13379 - protein, 107 aa, Artificial Sequence
  Description of Artificial Sequence: Synthetic polypeptide
  Variable LC Y087W
DILLTQSPVILSVSPGERVSFSCRASQSIGTNIHWYQQRTNGSPRLLIKYASESISGIPSRFSGSGSGTDFTLSINSVESEDIADYWCQQNNNWPTTFGAGTKLELK

SEQ ID NO: 13380 - protein, 107 aa, Artificial Sequence
  Description of Artificial Sequence: Synthetic polypeptide
  Variable LC Y087K
DILLTQSPVILSVSPGERVSFSCRASQSIGTNIHWYQQRTNGSPRLLIKYASESISGIPSRFSGSGSGTDFTLSINSVESEDIADYKCQQNNNWPTTFGAGTKLELK

SEQ ID NO: 13381 - protein, 107 aa, Artificial Sequence
  Description of Artificial Sequence: Synthetic polypeptide
  Variable LC Y087H
DILLTQSPVILSVSPGERVSFSCRASQSIGTNIHWYQQRTNGSPRLLIKYASESISGIPSRFSGSGSGTDFTLSINSVESEDIADYHCQQNNNWPTTFGAGTKLELK

SEQ ID NO: 13382 - protein, 107 aa, Artificial Sequence
  Description of Artificial Sequence: Synthetic polypeptide
  Variable LC Y087R
DILLTQSPVILSVSPGERVSFSCRASQSIGTNIHWYQQRTNGSPRLLIKYASESISGIPSRFSGSGSGTDFTLSINSVESEDIADYRCQQNNNWPTTFGAGTKLELK

SEQ ID NO: 13383 - protein, 107 aa, Artificial Sequence
  Description of Artificial Sequence: Synthetic polypeptide
  Variable LC Q089E
DILLTQSPVILSVSPGERVSFSCRASQSIGTNIHWYQQRTNGSPRLLIKYASESISGIPSRFSGSGSGTDFTLSINSVESEDIADYYCEQNNNWPTTFGAGTKLELK

SEQ ID NO: 13384 - protein, 107 aa, Artificial Sequence
  Description of Artificial Sequence: Synthetic polypeptide
  Variable LC N091L
DILLTQSPVILSVSPGERVSFSCRASQSIGTNIHWYQQRTNGSPRLLIKYASESISGIPSRFSGSGSGTDFTLSINSVESEDIADYYCQQLNNWPTTFGAGTKLELK

SEQ ID NO: 13385 - protein, 107 aa, Artificial Sequence
  Description of Artificial Sequence: Synthetic polypeptide
  Variable LC N091A
DILLTQSPVILSVSPGERVSFSCRASQSIGTNIHWYQQRTNGSPRLLIKYASESISGIPSRFSGSGSGTDFTLSINSVESEDIADYYCQQANNWPTTFGAGTKLELK

SEQ ID NO: 13386 - protein, 107 aa, Artificial Sequence
  Description of Artificial Sequence: Synthetic polypeptide
  Variable LC N091C
DILLTQSPVILSVSPGERVSFSCRASQSIGTNIHWYQQRTNGSPRLLIKYASESISGIPSRFSGSGSGTDFTLSINSVESEDIADYYCQQCNNWPTTFGAGTKLELK

SEQ ID NO: 13387 - protein, 107 aa, Artificial Sequence
  Description of Artificial Sequence: Synthetic polypeptide
  Variable LC N091I
DILLTQSPVILSVSPGERVSFSCRASQSIGTNIHWYQQRTNGSPRLLIKYASESISGIPSRFSGSGSGTDFTLSINSVESEDIADYYCQQINNWPTTFGAGTKLELK

SEQ ID NO: 13388 - protein, 107 aa, Artificial Sequence
  Description of Artificial Sequence: Synthetic polypeptide
  Variable LC N091M
DILLTQSPVILSVSPGERVSFSCRASQSIGTNIHWYQQRTNGSPRLLIKYASESISGIPSRFSGSGSGTDFTLSINSVESEDIADYYCQQMNNWPTTFGAGTKLELK

SEQ ID NO: 13389 - protein, 107 aa, Artificial Sequence
  Description of Artificial Sequence: Synthetic polypeptide
  Variable LC N091S
DILLTQSPVILSVSPGERVSFSCRASQSIGTNIHWYQQRTNGSPRLLIKYASESISGIPSRFSGSGSGTDFTLSINSVESEDIADYYCQQSNNWPTTFGAGTKLELK

SEQ ID NO: 13390 - protein, 107 aa, Artificial Sequence
  Description of Artificial Sequence: Synthetic polypeptide
  Variable LC N091T
DILLTQSPVILSVSPGERVSFSCRASQSIGTNIHWYQQRTNGSPRLLIKYASESISGIPSRFSGSGSGTDFTLSINSVESEDIADYYCQQTNNWPTTFGAGTKLELK

SEQ ID NO: 13391 - protein, 107 aa, Artificial Sequence
  Description of Artificial Sequence: Synthetic polypeptide
  Variable LC N091V
DILLTQSPVILSVSPGERVSFSCRASQSIGTNIHWYQQRTNGSPRLLIKYASESISGIPSRFSGSGSGTDFTLSINSVESEDIADYYCQQVNNWPTTFGAGTKLELK

SEQ ID NO: 13392 - protein, 107 aa, Artificial Sequence
  Description of Artificial Sequence: Synthetic polypeptide
  Variable LC N091H
DILLTQSPVILSVSPGERVSFSCRASQSIGTNIHWYQQRTNGSPRLLIKYASESISGIPSRFSGSGSGTDFTLSINSVESEDIADYYCQQHNNWPTTFGAGTKLELK

SEQ ID NO: 13393 - protein, 107 aa, Artificial Sequence
  Description of Artificial Sequence: Synthetic polypeptide
  Variable LC N091R
DILLTQSPVILSVSPGERVSFSCRASQSIGTNIHWYQQRTNGSPRLLIKYASESISGIPSRFSGSGSGTDFTLSINSVESEDIADYYCQQRNNWPTTFGAGTKLELK

SEQ ID NO: 13394 - protein, 107 aa, Artificial Sequence
  Description of Artificial Sequence: Synthetic polypeptide
  Variable LC N092C
DILLTQSPVILSVSPGERVSFSCRASQSIGTNIHWYQQRTNGSPRLLIKYASESISGIPSRFSGSGSGTDFTLSINSVESEDIADYYCQQNCNWPTTFGAGTKLELK

SEQ ID NO: 13395 - protein, 107 aa, Artificial Sequence
  Description of Artificial Sequence: Synthetic polypeptide
  Variable LC N092D
DILLTQSPVILSVSPGERVSFSCRASQSIGTNIHWYQQRTNGSPRLLIKYASESISGIPSRFSGSGSGTDFTLSINSVESEDIADYYCQQNDNWPTTFGAGTKLELK

SEQ ID NO: 13396 - protein, 107 aa, Artificial Sequence
  Description of Artificial Sequence: Synthetic polypeptide
  Variable LC N092L
DILLTQSPVILSVSPGERVSFSCRASQSIGTNIHWYQQRTNGSPRLLIKYASESISGIPSRFSGSGSGTDFTLSINSVESEDIADYYCQQNLNWPTTFGAGTKLELK

SEQ ID NO: 13397 - protein, 107 aa, Artificial Sequence
  Description of Artificial Sequence: Synthetic polypeptide
  Variable LC N092M
DILLTQSPVILSVSPGERVSFSCRASQSIGTNIHWYQQRTNGSPRLLIKYASESISGIPSRFSGSGSGTDFTLSINSVESEDIADYYCQQNMNWPTTFGAGTKLELK

SEQ ID NO: 13398 - protein, 107 aa, Artificial Sequence
  Description of Artificial Sequence: Synthetic polypeptide
  Variable LC N092S
DILLTQSPVILSVSPGERVSFSCRASQSIGTNIHWYQQRTNGSPRLLIKYASESISGIPSRFSGSGSGTDFTLSINSVESEDIADYYCQQNSNWPTTFGAGTKLELK

SEQ ID NO: 13399 - protein, 107 aa, Artificial Sequence
  Description of Artificial Sequence: Synthetic polypeptide
  Variable LC N092T
DILLTQSPVILSVSPGERVSFSCRASQSIGTNIHWYQQRTNGSPRLLIKYASESISGIPSRFSGSGSGTDFTLSINSVESEDIADYYCQQNTNWPTTFGAGTKLELK

SEQ ID NO: 13400 - protein, 107 aa, Artificial Sequence
  Description of Artificial Sequence: Synthetic polypeptide
  Variable LC N092V
DILLTQSPVILSVSPGERVSFSCRASQSIGTNIHWYQQRTNGSPRLLIKYASESISGIPSRFSGSGSGTDFTLSINSVESEDIADYYCQQNVNWPTTFGAGTKLELK

SEQ ID NO: 13401 - protein, 107 aa, Artificial Sequence
  Description of Artificial Sequence: Synthetic polypeptide
  Variable LC N092W
DILLTQSPVILSVSPGERVSFSCRASQSIGTNIHWYQQRTNGSPRLLIKYASESISGIPSRFSGSGSGTDFTLSINSVESEDIADYYCQQNWNWPTTFGAGTKLELK

SEQ ID NO: 13402 - protein, 107 aa, Artificial Sequence
  Description of Artificial Sequence: Synthetic polypeptide
  Variable LC N092Y
DILLTQSPVILSVSPGERVSFSCRASQSIGTNIHWYQQRTNGSPRLLIKYASESISGIPSRFSGSGSGTDFTLSINSVESEDIADYYCQQNYNWPTTFGAGTKLELK

SEQ ID NO: 13403 - protein, 107 aa, Artificial Sequence
  Description of Artificial Sequence: Synthetic polypeptide
  Variable LC N092H
DILLTQSPVILSVSPGERVSFSCRASQSIGTNIHWYQQRTNGSPRLLIKYASESISGIPSRFSGSGSGTDFTLSINSVESEDIADYYCQQNHNWPTTFGAGTKLELK

SEQ ID NO: 13404 - protein, 107 aa, Artificial Sequence
  Description of Artificial Sequence: Synthetic polypeptide
  Variable LC N092K
DILLTQSPVILSVSPGERVSFSCRASQSIGTNIHWYQQRTNGSPRLLIKYASESISGIPSRFSGSGSGTDFTLSINSVESEDIADYYCQQNKNWPTTFGAGTKLELK

SEQ ID NO: 13405 - protein, 107 aa, Artificial Sequence
  Description of Artificial Sequence: Synthetic polypeptide
  Variable LC N092R
DILLTQSPVILSVSPGERVSFSCRASQSIGTNIHWYQQRTNGSPRLLIKYASESISGIPSRFSGSGSGTDFTLSINSVESEDIADYYCQQNRNWPTTFGAGTKLELK

SEQ ID NO: 13406 - protein, 107 aa, Artificial Sequence
  Description of Artificial Sequence: Synthetic polypeptide
  Variable LC N093T
DILLTQSPVILSVSPGERVSFSCRASQSIGTNIHWYQQRTNGSPRLLIKYASESISGIPSRFSGSGSGTDFTLSINSVESEDIADYYCQQNNTWPTTFGAGTKLELK

SEQ ID NO: 13407 - protein, 107 aa, Artificial Sequence
  Description of Artificial Sequence: Synthetic polypeptide
  Variable LC T096L
DILLTQSPVILSVSPGERVSFSCRASQSIGTNIHWYQQRTNGSPRLLIKYASESISGIPSRFSGSGSGTDFTLSINSVESEDIADYYCQQNNNWPLTFGAGTKLELK

SEQ ID NO: 13408 - protein, 107 aa, Artificial Sequence
  Description of Artificial Sequence: Synthetic polypeptide
  Variable LC T096C
DILLTQSPVILSVSPGERVSFSCRASQSIGTNIHWYQQRTNGSPRLLIKYASESISGIPSRFSGSGSGTDFTLSINSVESEDIADYYCQQNNNWPCTFGAGTKLELK

SEQ ID NO: 13409 - protein, 107 aa, Artificial Sequence
  Description of Artificial Sequence: Synthetic polypeptide
  Variable LC T096M
DILLTQSPVILSVSPGERVSFSCRASQSIGTNIHWYQQRTNGSPRLLIKYASESISGIPSRFSGSGSGTDFTLSINSVESEDIADYYCQQNNNWPMTFGAGTKLELK

SEQ ID NO: 13410 - protein, 107 aa, Artificial Sequence
  Description of Artificial Sequence: Synthetic polypeptide
  Variable LC T096V
DILLTQSPVILSVSPGERVSFSCRASQSIGTNIHWYQQRTNGSPRLLIKYASESISGIPSRFSGSGSGTDFTLSINSVESEDIADYYCQQNNNWPVTFGAGTKLELK

SEQ ID NO: 13411 - protein, 107 aa, Artificial Sequence
  Description of Artificial Sequence: Synthetic polypeptide
  Variable LC T097L
DILLTQSPVILSVSPGERVSFSCRASQSIGTNIHWYQQRTNGSPRLLIKYASESISGIPSRFSGSGSGTDFTLSINSVESEDIADYYCQQNNNWPTLFGAGTKLELK

SEQ ID NO: 13412 - protein, 107 aa, Artificial Sequence
  Description of Artificial Sequence: Synthetic polypeptide
  Variable LC T097A
DILLTQSPVILSVSPGERVSFSCRASQSIGTNIHWYQQRTNGSPRLLIKYASESISGIPSRFSGSGSGTDFTLSINSVESEDIADYYCQQNNNWPTAFGAGTKLELK

SEQ ID NO: 13413 - protein, 107 aa, Artificial Sequence
  Description of Artificial Sequence: Synthetic polypeptide
  Variable LC T097D
DILLTQSPVILSVSPGERVSFSCRASQSIGTNIHWYQQRTNGSPRLLIKYASESISGIPSRFSGSGSGTDFTLSINSVESEDIADYYCQQNNNWPTDFGAGTKLELK

SEQ ID NO: 13414 - protein, 107 aa, Artificial Sequence
  Description of Artificial Sequence: Synthetic polypeptide
  Variable LC T097G
DILLTQSPVILSVSPGERVSFSCRASQSIGTNIHWYQQRTNGSPRLLIKYASESISGIPSRFSGSGSGTDFTLSINSVESEDIADYYCQQNNNWPTGFGAGTKLELK

SEQ ID NO: 13415 - protein, 107 aa, Artificial Sequence
  Description of Artificial Sequence: Synthetic polypeptide
  Variable LC T097Q
DILLTQSPVILSVSPGERVSFSCRASQSIGTNIHWYQQRTNGSPRLLIKYASESISGIPSRFSGSGSGTDFTLSINSVESEDIADYYCQQNNNWPTQFGAGTKLELK

SEQ ID NO: 13416 - protein, 107 aa, Artificial Sequence
  Description of Artificial Sequence: Synthetic polypeptide
  Variable LC T097S
DILLTQSPVILSVSPGERVSFSCRASQSIGTNIHWYQQRTNGSPRLLIKYASESISGIPSRFSGSGSGTDFTLSINSVESEDIADYYCQQNNNWPTSFGAGTKLELK

SEQ ID NO: 13417 - protein, 107 aa, Artificial Sequence
  Description of Artificial Sequence: Synthetic polypeptide
  Variable LC T097V
DILLTQSPVILSVSPGERVSFSCRASQSIGTNIHWYQQRTNGSPRLLIKYASESISGIPSRFSGSGSGTDFTLSINSVESEDIADYYCQQNNNWPTVFGAGTKLELK

SEQ ID NO: 13418 - protein, 107 aa, Artificial Sequence
  Description of Artificial Sequence: Synthetic polypeptide
  Variable LC T097K
DILLTQSPVILSVSPGERVSFSCRASQSIGTNIHWYQQRTNGSPRLLIKYASESISGIPSRFSGSGSGTDFTLSINSVESEDIADYYCQQNNNWPTKFGAGTKLELK

SEQ ID NO: 13419 - protein, 107 aa, Artificial Sequence
  Description of Artificial Sequence: Synthetic polypeptide
  Variable LC T097R
DILLTQSPVILSVSPGERVSFSCRASQSIGTNIHWYQQRTNGSPRLLIKYASESISGIPSRFSGSGSGTDFTLSINSVESEDIADYYCQQNNNWPTRFGAGTKLELK

SEQ ID NO: 13420 - protein, 107 aa, Artificial Sequence
  Description of Artificial Sequence: Synthetic polypeptide
  Variable LC F098A
DILLTQSPVILSVSPGERVSFSCRASQSIGTNIHWYQQRTNGSPRLLIKYASESISGIPSRFSGSGSGTDFTLSINSVESEDIADYYCQQNNNWPTTAGAGTKLELK

SEQ ID NO: 13421 - protein, 107 aa, Artificial Sequence
  Description of Artificial Sequence: Synthetic polypeptide
  Variable LC F098M
DILLTQSPVILSVSPGERVSFSCRASQSIGTNIHWYQQRTNGSPRLLIKYASESISGIPSRFSGSGSGTDFTLSINSVESEDIADYYCQQNNNWPTTMGAGTKLELK

SEQ ID NO: 13422 - protein, 107 aa, Artificial Sequence
  Description of Artificial Sequence: Synthetic polypeptide
  Variable LC F098S
DILLTQSPVILSVSPGERVSFSCRASQSIGTNIHWYQQRTNGSPRLLIKYASESISGIPSRFSGSGSGTDFTLSINSVESEDIADYYCQQNNNWPTTSGAGTKLELK

SEQ ID NO: 13423 - protein, 107 aa, Artificial Sequence
  Description of Artificial Sequence: Synthetic polypeptide
  Variable LC F098V
DILLTQSPVILSVSPGERVSFSCRASQSIGTNIHWYQQRTNGSPRLLIKYASESISGIPSRFSGSGSGTDFTLSINSVESEDIADYYCQQNNNWPTTVGAGTKLELK

SEQ ID NO: 13424 - protein, 107 aa, Artificial Sequence
  Description of Artificial Sequence: Synthetic polypeptide
  Variable LC F098Y
DILLTQSPVILSVSPGERVSFSCRASQSIGTNIHWYQQRTNGSPRLLIKYASESISGIPSRFSGSGSGTDFTLSINSVESEDIADYYCQQNNNWPTTYGAGTKLELK

SEQ ID NO: 13425 - protein, 107 aa, Artificial Sequence
  Description of Artificial Sequence: Synthetic polypeptide
  Variable LC G099L
DILLTQSPVILSVSPGERVSFSCRASQSIGTNIHWYQQRTNGSPRLLIKYASESISGIPSRFSGSGSGTDFTLSINSVESEDIADYYCQQNNNWPTTFLAGTKLELK

SEQ ID NO: 13426 - protein, 107 aa, Artificial Sequence
  Description of Artificial Sequence: Synthetic polypeptide
  Variable LC G099D
DILLTQSPVILSVSPGERVSFSCRASQSIGTNIHWYQQRTNGSPRLLIKYASESISGIPSRFSGSGSGTDFTLSINSVESEDIADYYCQQNNNWPTTFDAGTKLELK

SEQ ID NO: 13427 - protein, 107 aa, Artificial Sequence
  Description of Artificial Sequence: Synthetic polypeptide
  Variable LC G099E
DILLTQSPVILSVSPGERVSFSCRASQSIGTNIHWYQQRTNGSPRLLIKYASESISGIPSRFSGSGSGTDFTLSINSVESEDIADYYCQQNNNWPTTFEAGTKLELK

SEQ ID NO: 13428 - protein, 107 aa, Artificial Sequence
  Description of Artificial Sequence: Synthetic polypeptide
  Variable LC G099F
DILLTQSPVILSVSPGERVSFSCRASQSIGTNIHWYQQRTNGSPRLLIKYASESISGIPSRFSGSGSGTDFTLSINSVESEDIADYYCQQNNNWPTTFFAGTKLELK

SEQ ID NO: 13429 - protein, 107 aa, Artificial Sequence
  Description of Artificial Sequence: Synthetic polypeptide
  Variable LC G099I
DILLTQSPVILSVSPGERVSFSCRASQSIGTNIHWYQQRTNGSPRLLIKYASESISGIPSRFSGSGSGTDFTLSINSVESEDIADYYCQQNNNWPTTFIAGTKLELK

SEQ ID NO: 13430 - protein, 107 aa, Artificial Sequence
  Description of Artificial Sequence: Synthetic polypeptide
  Variable LC G099M
DILLTQSPVILSVSPGERVSFSCRASQSIGTNIHWYQQRTNGSPRLLIKYASESISGIPSRFSGSGSGTDFTLSINSVESEDIADYYCQQNNNWPTTFMAGTKLELK

SEQ ID NO: 13431 - protein, 107 aa, Artificial Sequence
  Description of Artificial Sequence: Synthetic polypeptide
  Variable LC G099N
DILLTQSPVILSVSPGERVSFSCRASQSIGTNIHWYQQRTNGSPRLLIKYASESISGIPSRFSGSGSGTDFTLSINSVESEDIADYYCQQNNNWPTTFNAGTKLELK

SEQ ID NO: 13432 - protein, 107 aa, Artificial Sequence
  Description of Artificial Sequence: Synthetic polypeptide
  Variable LC G099S
DILLTQSPVILSVSPGERVSFSCRASQSIGTNIHWYQQRTNGSPRLLIKYASESISGIPSRFSGSGSGTDFTLSINSVESEDIADYYCQQNNNWPTTFSAGTKLELK

SEQ ID NO: 13433 - protein, 107 aa, Artificial Sequence
  Description of Artificial Sequence: Synthetic polypeptide
  Variable LC G099T
DILLTQSPVILSVSPGERVSFSCRASQSIGTNIHWYQQRTNGSPRLLIKYASESISGIPSRFSGSGSGTDFTLSINSVESEDIADYYCQQNNNWPTTFTAGTKLELK

SEQ ID NO: 13434 - protein, 107 aa, Artificial Sequence
  Description of Artificial Sequence: Synthetic polypeptide
  Variable LC G099V
DILLTQSPVILSVSPGERVSFSCRASQSIGTNIHWYQQRTNGSPRLLIKYASESISGIPSRFSGSGSGTDFTLSINSVESEDIADYYCQQNNNWPTTFVAGTKLELK

SEQ ID NO: 13435 - protein, 107 aa, Artificial Sequence
  Description of Artificial Sequence: Synthetic polypeptide
  Variable LC G099K
DILLTQSPVILSVSPGERVSFSCRASQSIGTNIHWYQQRTNGSPRLLIKYASESISGIPSRFSGSGSGTDFTLSINSVESEDIADYYCQQNNNWPTTFKAGTKLELK

SEQ ID NO: 13436 - protein, 107 aa, Artificial Sequence
  Description of Artificial Sequence: Synthetic polypeptide
  Variable LC G099H
DILLTQSPVILSVSPGERVSFSCRASQSIGTNIHWYQQRTNGSPRLLIKYASESISGIPSRFSGSGSGTDFTLSINSVESEDIADYYCQQNNNWPTTFHAGTKLELK

SEQ ID NO: 13437 - protein, 107 aa, Artificial Sequence
  Description of Artificial Sequence: Synthetic polypeptide
  Variable LC D001W
WILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13438 - protein, 107 aa, Artificial Sequence
  Description of Artificial Sequence: Synthetic polypeptide
  Variable LC I002C
DCLLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13439 - protein, 107 aa, Artificial Sequence
  Description of Artificial Sequence: Synthetic polypeptide
  Variable LC I002V
DVLLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13440 - protein, 107 aa, Artificial Sequence
  Description of Artificial Sequence: Synthetic polypeptide
  Variable LC I002W
DWLLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13441 - protein, 107 aa, Artificial Sequence
  Description of Artificial Sequence: Synthetic polypeptide
  Variable LC L003D
DIDLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13442 - protein, 107 aa, Artificial Sequence
  Description of Artificial Sequence: Synthetic polypeptide
  Variable LC L003F
DIFLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13443 - protein, 107 aa, Artificial Sequence
  Description of Artificial Sequence: Synthetic polypeptide
  Variable LC L003G
DIGLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13444 - protein, 107 aa, Artificial Sequence
  Description of Artificial Sequence: Synthetic polypeptide
  Variable LC L003S
DISLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13445 - protein, 107 aa, Artificial Sequence
  Description of Artificial Sequence: Synthetic polypeptide
  Variable LC L003T
DITLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13446 - protein, 107 aa, Artificial Sequence
  Description of Artificial Sequence: Synthetic polypeptide
  Variable LC L003V
DIVLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13447 - protein, 107 aa, Artificial Sequence
  Description of Artificial Sequence: Synthetic polypeptide
  Variable LC L003W
DIWLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13448 - protein, 107 aa, Artificial Sequence
  Description of Artificial Sequence: Synthetic polypeptide
  Variable LC L003Y
DIYLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13449 - protein, 107 aa, Artificial Sequence
  Description of Artificial Sequence: Synthetic polypeptide
  Variable LC L003R
DIRLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13450 - protein, 107 aa, Artificial Sequence
  Description of Artificial Sequence: Synthetic polypeptide
  Variable LC L004C
DILCTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13451 - protein, 107 aa, Artificial Sequence
  Description of Artificial Sequence: Synthetic polypeptide
  Variable LC L004E
DILETQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13452 - protein, 107 aa, Artificial Sequence
  Description of Artificial Sequence: Synthetic polypeptide
  Variable LC L004F
DILFTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13453 - protein, 107 aa, Artificial Sequence
  Description of Artificial Sequence: Synthetic polypeptide
  Variable LC L004I
DILITQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13454 - protein, 107 aa, Artificial Sequence
  Description of Artificial Sequence: Synthetic polypeptide
  Variable LC L004P
DILPTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13455 - protein, 107 aa, Artificial Sequence
  Description of Artificial Sequence: Synthetic polypeptide
  Variable LC L004S
DILSTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13456 - protein, 107 aa, Artificial Sequence
  Description of Artificial Sequence: Synthetic polypeptide
  Variable LC L004T
DILTTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13457 - protein, 107 aa, Artificial Sequence
  Description of Artificial Sequence: Synthetic polypeptide
  Variable LC L004V
DILVTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13458 - protein, 107 aa, Artificial Sequence
  Description of Artificial Sequence: Synthetic polypeptide
  Variable LC L004W
DILWTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13459 - protein, 107 aa, Artificial Sequence
  Description of Artificial Sequence: Synthetic polypeptide
  Variable LC L004K
DILKTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13460 - protein, 107 aa, Artificial Sequence
  Description of Artificial Sequence: Synthetic polypeptide
  Variable LC L004H
DILHTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13461 - protein, 107 aa, Artificial Sequence
  Description of Artificial Sequence: Synthetic polypeptide
  Variable LC L004R
DILRTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13462 - protein, 107 aa, Artificial Sequence
  Description of Artificial Sequence: Synthetic polypeptide
  Variable LC T005A
DILLAQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13463 - protein, 107 aa, Artificial Sequence
  Description of Artificial Sequence: Synthetic polypeptide
  Variable LC T005C
DILLCQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13464 - protein, 107 aa, Artificial Sequence
  Description of Artificial Sequence: Synthetic polypeptide
  Variable LC T005D
DILLDQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13465 - protein, 107 aa, Artificial Sequence
  Description of Artificial Sequence: Synthetic polypeptide
  Variable LC T005E
DILLEQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13466 - protein, 107 aa, Artificial Sequence
  Description of Artificial Sequence: Synthetic polypeptide
  Variable LC T005F
DILLFQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13467 - protein, 107 aa, Artificial Sequence
  Description of Artificial Sequence: Synthetic polypeptide
  Variable LC T005G
DILLGQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13468 - protein, 107 aa, Artificial Sequence
  Description of Artificial Sequence: Synthetic polypeptide
  Variable LC T005N
DILLNQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13469 - protein, 107 aa, Artificial Sequence
  Description of Artificial Sequence: Synthetic polypeptide
  Variable LC T005S
DILLSQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13470 - protein, 107 aa, Artificial Sequence
  Description of Artificial Sequence: Synthetic polypeptide
  Variable LC T005W
DILLWQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13471 - protein, 107 aa, Artificial Sequence
  Description of Artificial Sequence: Synthetic polypeptide
  Variable LC T005L
DILLLQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13472 - protein, 107 aa, Artificial Sequence
  Description of Artificial Sequence: Synthetic polypeptide
  Variable LC T005K
DILLKQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13473 - protein, 107 aa, Artificial Sequence
  Description of Artificial Sequence: Synthetic polypeptide
  Variable LC T005H
DILLHQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13474 - protein, 107 aa, Artificial Sequence
  Description of Artificial Sequence: Synthetic polypeptide
  Variable LC T005R
DILLRQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13475 - protein, 107 aa, Artificial Sequence
  Description of Artificial Sequence: Synthetic polypeptide
  Variable LC R024A
DILLTQSPVILSVSPGERVSFSCAASQSIGTNIHWYQQRTNGSPRLLIKYASESISGIPSRFSGSGSGTDFTLSINSVESEDIADYYCQQNNNWPTTFGQGTKLELK

SEQ ID NO: 13476 - protein, 107 aa, Artificial Sequence
  Description of Artificial Sequence: Synthetic polypeptide
  Variable LC R024C
DILLTQSPVILSVSPGERVSFSCCASQSIGTNIHWYQQRTNGSPRLLIKYASESISGIPSRFSGSGSGTDFTLSINSVESEDIADYYCQQNNNWPTTFGQGTKLELK

SEQ ID NO: 13477 - protein, 107 aa, Artificial Sequence
  Description of Artificial Sequence: Synthetic polypeptide
  Variable LC R024F
DILLTQSPVILSVSPGERVSFSCFASQSIGTNIHWYQQRTNGSPRLLIKYASESISGIPSRFSGSGSGTDFTLSINSVESEDIADYYCQQNNNWPTTFGQGTKLELK

SEQ ID NO: 13478 - protein, 107 aa, Artificial Sequence
  Description of Artificial Sequence: Synthetic polypeptide
  Variable LC R024L
DILLTQSPVILSVSPGERVSFSCLASQSIGTNIHWYQQRTNGSPRLLIKYASESISGIPSRFSGSGSGTDFTLSINSVESEDIADYYCQQNNNWPTTFGQGTKLELK

SEQ ID NO: 13479 - protein, 107 aa, Artificial Sequence
  Description of Artificial Sequence: Synthetic polypeptide
  Variable LC R024M
DILLTQSPVILSVSPGERVSFSCMASQSIGTNIHWYQQRTNGSPRLLIKYASESISGIPSRFSGSGSGTDFTLSINSVESEDIADYYCQQNNNWPTTFGQGTKLELK

SEQ ID NO: 13480 - protein, 107 aa, Artificial Sequence
  Description of Artificial Sequence: Synthetic polypeptide
  Variable LC R024S
DILLTQSPVILSVSPGERVSFSCSASQSIGTNIHWYQQRTNGSPRLLIKYASESISGIPSRFSGSGSGTDFTLSINSVESEDIADYYCQQNNNWPTTFGQGTKLELK

SEQ ID NO: 13481 - protein, 107 aa, Artificial Sequence
  Description of Artificial Sequence: Synthetic polypeptide
  Variable LC R024W
DILLTQSPVILSVSPGERVSFSCWASQSIGTNIHWYQQRTNGSPRLLIKYASESISGIPSRFSGSGSGTDFTLSINSVESEDIADYYCQQNNNWPTTFGQGTKLELK

SEQ ID NO: 13482 - protein, 107 aa, Artificial Sequence
  Description of Artificial Sequence: Synthetic polypeptide
  Variable LC R024Y
DILLTQSPVILSVSPGERVSFSCYASQSIGTNIHWYQQRTNGSPRLLIKYASESISGIPSRFSGSGSGTDFTLSINSVESEDIADYYCQQNNNWPTTFGQGTKLELK

SEQ ID NO: 13483 - protein, 107 aa, Artificial Sequence
  Description of Artificial Sequence: Synthetic polypeptide
  Variable LC A025C
DILLTQSPVILSVSPGERVSFSCRCSQSIGTNIHWYQQRTNGSPRLLIKYASESISGIPSRFSGSGSGTDFTLSINSVESEDIADYYCQQNNNWPTTFGQGTKLELK

SEQ ID NO: 13484 - protein, 107 aa, Artificial Sequence
  Description of Artificial Sequence: Synthetic polypeptide
  Variable LC A025G
DILLTQSPVILSVSPGERVSFSCRGSQSIGTNIHWYQQRTNGSPRLLIKYASESISGIPSRFSGSGSGTDFTLSINSVESEDIADYYCQQNNNWPTTFGQGTKLELK

SEQ ID NO: 13485 - protein, 107 aa, Artificial Sequence
  Description of Artificial Sequence: Synthetic polypeptide
  Variable LC A025L
DILLTQSPVILSVSPGERVSFSCRLSQSIGTNIHWYQQRTNGSPRLLIKYASESISGIPSRFSGSGSGTDFTLSINSVESEDIADYYCQQNNNWPTTFGQGTKLELK

SEQ ID NO: 13486 - protein, 107 aa, Artificial Sequence
  Description of Artificial Sequence: Synthetic polypeptide
  Variable LC A025V
DILLTQSPVILSVSPGERVSFSCRVSQSIGTNIHWYQQRTNGSPRLLIKYASESISGIPSRFSGSGSGTDFTLSINSVESEDIADYYCQQNNNWPTTFGQGTKLELK

SEQ ID NO: 13487 - protein, 107 aa, Artificial Sequence
  Description of Artificial Sequence: Synthetic polypeptide
  Variable LC S026A
DILLTQSPVILSVSPGERVSFSCRAAQSIGTNIHWYQQRTNGSPRLLIKYASESISGIPSRFSGSGSGTDFTLSINSVESEDIADYYCQQNNNWPTTFGQGTKLELK

SEQ ID NO: 13488 - protein, 107 aa, Artificial Sequence
  Description of Artificial Sequence: Synthetic polypeptide
  Variable LC S026C
DILLTQSPVILSVSPGERVSFSCRACQSIGTNIHWYQQRTNGSPRLLIKYASESISGIPSRFSGSGSGTDFTLSINSVESEDIADYYCQQNNNWPTTFGQGTKLELK

SEQ ID NO: 13489 - protein, 107 aa, Artificial Sequence
  Description of Artificial Sequence: Synthetic polypeptide
  Variable LC S026D
DILLTQSPVILSVSPGERVSFSCRADQSIGTNIHWYQQRTNGSPRLLIKYASESISGIPSRFSGSGSGTDFTLSINSVESEDIADYYCQQNNNWPTTFGQGTKLELK

SEQ ID NO: 13490 - protein, 107 aa, Artificial Sequence
  Description of Artificial Sequence: Synthetic polypeptide
  Variable LC S026I
DILLTQSPVILSVSPGERVSFSCRAIQSIGTNIHWYQQRTNGSPRLLIKYASESISGIPSRFSGSGSGTDFTLSINSVESEDIADYYCQQNNNWPTTFGQGTKLELK

SEQ ID NO: 13491 - protein, 107 aa, Artificial Sequence
  Description of Artificial Sequence: Synthetic polypeptide
  Variable LC S026M
DILLTQSPVILSVSPGERVSFSCRAMQSIGTNIHWYQQRTNGSPRLLIKYASESISGIPSRFSGSGSGTDFTLSINSVESEDIADYYCQQNNNWPTTFGQGTKLELK

SEQ ID NO: 13492 - protein, 107 aa, Artificial Sequence
  Description of Artificial Sequence: Synthetic polypeptide
  Variable LC S026N
DILLTQSPVILSVSPGERVSFSCRANQSIGTNIHWYQQRTNGSPRLLIKYASESISGIPSRFSGSGSGTDFTLSINSVESEDIADYYCQQNNNWPTTFGQGTKLELK

SEQ ID NO: 13493 - protein, 107 aa, Artificial Sequence
  Description of Artificial Sequence: Synthetic polypeptide
  Variable LC S026V
DILLTQSPVILSVSPGERVSFSCRAVQSIGTNIHWYQQRTNGSPRLLIKYASESISGIPSRFSGSGSGTDFTLSINSVESEDIADYYCQQNNNWPTTFGQGTKLELK

SEQ ID NO: 13494 - protein, 107 aa, Artificial Sequence
  Description of Artificial Sequence: Synthetic polypeptide
  Variable LC S026W
DILLTQSPVILSVSPGERVSFSCRAWQSIGTNIHWYQQRTNGSPRLLIKYASESISGIPSRFSGSGSGTDFTLSINSVESEDIADYYCQQNNNWPTTFGQGTKLELK

SEQ ID NO: 13495 - protein, 107 aa, Artificial Sequence
  Description of Artificial Sequence: Synthetic polypeptide
  Variable LC S026L
DILLTQSPVILSVSPGERVSFSCRALQSIGTNIHWYQQRTNGSPRLLIKYASESISGIPSRFSGSGSGTDFTLSINSVESEDIADYYCQQNNNWPTTFGQGTKLELK

SEQ ID NO: 13496 - protein, 107 aa, Artificial Sequence
  Description of Artificial Sequence: Synthetic polypeptide
  Variable LC S026G
DILLTQSPVILSVSPGERVSFSCRAGQSIGTNIHWYQQRTNGSPRLLIKYASESISGIPSRFSGSGSGTDFTLSINSVESEDIADYYCQQNNNWPTTFGQGTKLELK

SEQ ID NO: 13497 - protein, 107 aa, Artificial Sequence
  Description of Artificial Sequence: Synthetic polypeptide
  Variable LC S026H
DILLTQSPVILSVSPGERVSFSCRAHQSIGTNIHWYQQRTNGSPRLLIKYASESISGIPSRFSGSGSGTDFTLSINSVESEDIADYYCQQNNNWPTTFGQGTKLELK

SEQ ID NO: 13498 - protein, 107 aa, Artificial Sequence
  Description of Artificial Sequence: Synthetic polypeptide
  Variable LC S026R
DILLTQSPVILSVSPGERVSFSCRARQSIGTNIHWYQQRTNGSPRLLIKYASESISGIPSRFSGSGSGTDFTLSINSVESEDIADYYCQQNNNWPTTFGQGTKLELK

SEQ ID NO: 13499 - protein, 107 aa, Artificial Sequence
  Description of Artificial Sequence: Synthetic polypeptide
  Variable LC Q027A
DILLTQSPVILSVSPGERVSFSCRASASIGTNIHWYQQRTNGSPRLLIKYASESISGIPSRFSGSGSGTDFTLSINSVESEDIADYYCQQNNNWPTTFGQGTKLELK

SEQ ID NO: 13500 - protein, 107 aa, Artificial Sequence
  Description of Artificial Sequence: Synthetic polypeptide
  Variable LC Q027D
DILLTQSPVILSVSPGERVSFSCRASDSIGTNIHWYQQRTNGSPRLLIKYASESISGIPSRFSGSGSGTDFTLSINSVESEDIADYYCQQNNNWPTTFGQGTKLELK

SEQ ID NO: 13501 - protein, 107 aa, Artificial Sequence
  Description of Artificial Sequence: Synthetic polypeptide
  Variable LC Q027E
DILLTQSPVILSVSPGERVSFSCRASESIGTNIHWYQQRTNGSPRLLIKYASESISGIPSRFSGSGSGTDFTLSINSVESEDIADYYCQQNNNWPTTFGQGTKLELK

SEQ ID NO: 13502 - protein, 107 aa, Artificial Sequence
  Description of Artificial Sequence: Synthetic polypeptide
  Variable LC Q027F
DILLTQSPVILSVSPGERVSFSCRASFSIGTNIHWYQQRTNGSPRLLIKYASESISGIPSRFSGSGSGTDFTLSINSVESEDIADYYCQQNNNWPTTFGQGTKLELK

SEQ ID NO: 13503 - protein, 107 aa, Artificial Sequence
  Description of Artificial Sequence: Synthetic polypeptide
  Variable LC Q027I
DILLTQSPVILSVSPGERVSFSCRASISIGTNIHWYQQRTNGSPRLLIKYASESISGIPSRFSGSGSGTDFTLSINSVESEDIADYYCQQNNNWPTTFGQGTKLELK

SEQ ID NO: 13504 - protein, 107 aa, Artificial Sequence
  Description of Artificial Sequence: Synthetic polypeptide
  Variable LC Q027M
DILLTQSPVILSVSPGERVSFSCRASMSIGTNIHWYQQRTNGSPRLLIKYASESISGIPSRFSGSGSGTDFTLSINSVESEDIADYYCQQNNNWPTTFGQGTKLELK

SEQ ID NO: 13505 - protein, 107 aa, Artificial Sequence
  Description of Artificial Sequence: Synthetic polypeptide
  Variable LC Q027N
DILLTQSPVILSVSPGERVSFSCRASNSIGTNIHWYQQRTNGSPRLLIKYASESISGIPSRFSGSGSGTDFTLSINSVESEDIADYYCQQNNNWPTTFGQGTKLELK

SEQ ID NO: 13506 - protein, 107 aa, Artificial Sequence
  Description of Artificial Sequence: Synthetic polypeptide
  Variable LC Q027P
DILLTQSPVILSVSPGERVSFSCRASPSIGTNIHWYQQRTNGSPRLLIKYASESISGIPSRFSGSGSGTDFTLSINSVESEDIADYYCQQNNNWPTTFGQGTKLELK

SEQ ID NO: 13507 - protein, 107 aa, Artificial Sequence
  Description of Artificial Sequence: Synthetic polypeptide
  Variable LC Q027T
DILLTQSPVILSVSPGERVSFSCRASTSIGTNIHWYQQRTNGSPRLLIKYASESISGIPSRFSGSGSGTDFTLSINSVESEDIADYYCQQNNNWPTTFGQGTKLELK

SEQ ID NO: 13508 - protein, 107 aa, Artificial Sequence
  Description of Artificial Sequence: Synthetic polypeptide
  Variable LC S028A
DILLTQSPVILSVSPGERVSFSCRASQAIGTNIHWYQQRTNGSPRLLIKYASESISGIPSRFSGSGSGTDFTLSINSVESEDIADYYCQQNNNWPTTFGQGTKLELK

SEQ ID NO: 13509 - protein, 107 aa, Artificial Sequence
  Description of Artificial Sequence: Synthetic polypeptide
  Variable LC S028D
DILLTQSPVILSVSPGERVSFSCRASQDIGTNIHWYQQRTNGSPRLLIKYASESISGIPSRFSGSGSGTDFTLSINSVESEDIADYYCQQNNNWPTTFGQGTKLELK

SEQ ID NO: 13510 - protein, 107 aa, Artificial Sequence
  Description of Artificial Sequence: Synthetic polypeptide
  Variable LC S028N
DILLTQSPVILSVSPGERVSFSCRASQNIGTNIHWYQQRTNGSPRLLIKYASESISGIPSRFSGSGSGTDFTLSINSVESEDIADYYCQQNNNWPTTFGQGTKLELK

SEQ ID NO: 13511 - protein, 107 aa, Artificial Sequence
  Description of Artificial Sequence: Synthetic polypeptide
  Variable LC S028Q
DILLTQSPVILSVSPGERVSFSCRASQQIGTNIHWYQQRTNGSPRLLIKYASESISGIPSRFSGSGSGTDFTLSINSVESEDIADYYCQQNNNWPTTFGQGTKLELK

SEQ ID NO: 13512 - protein, 107 aa, Artificial Sequence
  Description of Artificial Sequence: Synthetic polypeptide
  Variable LC S028L
DILLTQSPVILSVSPGERVSFSCRASQLIGTNIHWYQQRTNGSPRLLIKYASESISGIPSRFSGSGSGTDFTLSINSVESEDIADYYCQQNNNWPTTFGQGTKLELK

SEQ ID NO: 13513 - protein, 107 aa, Artificial Sequence
  Description of Artificial Sequence: Synthetic polypeptide
  Variable LC S028K
DILLTQSPVILSVSPGERVSFSCRASQKIGTNIHWYQQRTNGSPRLLIKYASESISGIPSRFSGSGSGTDFTLSINSVESEDIADYYCQQNNNWPTTFGQGTKLELK

SEQ ID NO: 13514 - protein, 107 aa, Artificial Sequence
  Description of Artificial Sequence: Synthetic polypeptide
  Variable LC S028H
DILLTQSPVILSVSPGERVSFSCRASQHIGTNIHWYQQRTNGSPRLLIKYASESISGIPSRFSGSGSGTDFTLSINSVESEDIADYYCQQNNNWPTTFGQGTKLELK

SEQ ID NO: 13515 - protein, 107 aa, Artificial Sequence
  Description of Artificial Sequence: Synthetic polypeptide
  Variable LC I029A
DILLTQSPVILSVSPGERVSFSCRASQSAGTNIHWYQQRTNGSPRLLIKYASESISGIPSRFSGSGSGTDFTLSINSVESEDIADYYCQQNNNWPTTFGQGTKLELK

SEQ ID NO: 13516 - protein, 107 aa, Artificial Sequence
  Description of Artificial Sequence: Synthetic polypeptide
  Variable LC I029E
DILLTQSPVILSVSPGERVSFSCRASQSEGTNIHWYQQRTNGSPRLLIKYASESISGIPSRFSGSGSGTDFTLSINSVESEDIADYYCQQNNNWPTTFGQGTKLELK

SEQ ID NO: 13517 - protein, 107 aa, Artificial Sequence
  Description of Artificial Sequence: Synthetic polypeptide
  Variable LC I029F
DILLTQSPVILSVSPGERVSFSCRASQSFGTNIHWYQQRTNGSPRLLIKYASESISGIPSRFSGSGSGTDFTLSINSVESEDIADYYCQQNNNWPTTFGQGTKLELK

SEQ ID NO: 13518 - protein, 107 aa, Artificial Sequence
  Description of Artificial Sequence: Synthetic polypeptide
  Variable LC I029S
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGQGTKLELK

SEQ ID NO: 13519 - protein, 107 aa, Artificial Sequence
  Description of Artificial Sequence: Synthetic polypeptide
  Variable LC I029T
DILLTQSPVILSVSPGERVSFSCRASQSTGTNIHWYQQRTNGSPRLLIKYASESISGIPSRFSGSGSGTDFTLSINSVESEDIADYYCQQNNNWPTTFGQGTKLELK

SEQ ID NO: 13520 - protein, 107 aa, Artificial Sequence
  Description of Artificial Sequence: Synthetic polypeptide
  Variable LC I029R
DILLTQSPVILSVSPGERVSFSCRASQSRGTNIHWYQQRTNGSPRLLIKYASESISGIPSRFSGSGSGTDFTLSINSVESEDIADYYCQQNNNWPTTFGQGTKLELK

SEQ ID NO: 13521 - protein, 107 aa, Artificial Sequence
  Description of Artificial Sequence: Synthetic polypeptide
  Variable LC G030A
DILLTQSPVILSVSPGERVSFSCRASQSIATNIHWYQQRTNGSPRLLIKYASESISGIPSRFSGSGSGTDFTLSINSVESEDIADYYCQQNNNWPTTFGQGTKLELK

SEQ ID NO: 13522 - protein, 107 aa, Artificial Sequence
  Description of Artificial Sequence: Synthetic polypeptide
  Variable LC G030E
DILLTQSPVILSVSPGERVSFSCRASQSIETNIHWYQQRTNGSPRLLIKYASESISGIPSRFSGSGSGTDFTLSINSVESEDIADYYCQQNNNWPTTFGQGTKLELK

SEQ ID NO: 13523 - protein, 107 aa, Artificial Sequence
  Description of Artificial Sequence: Synthetic polypeptide
  Variable LC G030F
DILLTQSPVILSVSPGERVSFSCRASQSIFTNIHWYQQRTNGSPRLLIKYASESISGIPSRFSGSGSGTDFTLSINSVESEDIADYYCQQNNNWPTTFGQGTKLELK

SEQ ID NO: 13524 - protein, 107 aa, Artificial Sequence
  Description of Artificial Sequence: Synthetic polypeptide
  Variable LC G030I
DILLTQSPVILSVSPGERVSFSCRASQSIITNIHWYQQRTNGSPRLLIKYASESISGIPSRFSGSGSGTDFTLSINSVESEDIADYYCQQNNNWPTTFGQGTKLELK

SEQ ID NO: 13525 - protein, 107 aa, Artificial Sequence
  Description of Artificial Sequence: Synthetic polypeptide
  Variable LC G030M
DILLTQSPVILSVSPGERVSFSCRASQSIMTNIHWYQQRTNGSPRLLIKYASESISGIPSRFSGSGSGTDFTLSINSVESEDIADYYCQQNNNWPTTFGQGTKLELK

SEQ ID NO: 13526 - protein, 107 aa, Artificial Sequence
  Description of Artificial Sequence: Synthetic polypeptide
  Variable LC G030P
DILLTQSPVILSVSPGERVSFSCRASQSIPTNIHWYQQRTNGSPRLLIKYASESISGIPSRFSGSGSGTDFTLSINSVESEDIADYYCQQNNNWPTTFGQGTKLELK

SEQ ID NO: 13527 - protein, 107 aa, Artificial Sequence
  Description of Artificial Sequence: Synthetic polypeptide
  Variable LC G030Q
DILLTQSPVILSVSPGERVSFSCRASQSIQTNIHWYQQRTNGSPRLLIKYASESISGIPSRFSGSGSGTDFTLSINSVESEDIADYYCQQNNNWPTTFGQGTKLELK

SEQ ID NO: 13528 - protein, 107 aa, Artificial Sequence
  Description of Artificial Sequence: Synthetic polypeptide
  Variable LC G030S
DILLTQSPVILSVSPGERVSFSCRASQSISTNIHWYQQRTNGSPRLLIKYASESISGIPSRFSGSGSGTDFTLSINSVESEDIADYYCQQNNNWPTTFGQGTKLELK

SEQ ID NO: 13529 - protein, 107 aa, Artificial Sequence
  Description of Artificial Sequence: Synthetic polypeptide
  Variable LC G030V
DILLTQSPVILSVSPGERVSFSCRASQSIVTNIHWYQQRTNGSPRLLIKYASESISGIPSRFSGSGSGTDFTLSINSVESEDIADYYCQQNNNWPTTFGQGTKLELK

SEQ ID NO: 13530 - protein, 107 aa, Artificial Sequence
  Description of Artificial Sequence: Synthetic polypeptide
  Variable LC G030Y
DILLTQSPVILSVSPGERVSFSCRASQSIYTNIHWYQQRTNGSPRLLIKYASESISGIPSRFSGSGSGTDFTLSINSVESEDIADYYCQQNNNWPTTFGQGTKLELK

SEQ ID NO: 13531 - protein, 107 aa, Artificial Sequence
  Description of Artificial Sequence: Synthetic polypeptide
  Variable LC G030L
DILLTQSPVILSVSPGERVSFSCRASQSILTNIHWYQQRTNGSPRLLIKYASESISGIPSRFSGSGSGTDFTLSINSVESEDIADYYCQQNNNWPTTFGQGTKLELK

SEQ ID NO: 13532 - protein, 107 aa, Artificial Sequence
  Description of Artificial Sequence: Synthetic polypeptide
  Variable LC G030K
DILLTQSPVILSVSPGERVSFSCRASQSIKTNIHWYQQRTNGSPRLLIKYASESISGIPSRFSGSGSGTDFTLSINSVESEDIADYYCQQNNNWPTTFGQGTKLELK

SEQ ID NO: 13533 - protein, 107 aa, Artificial Sequence
  Description of Artificial Sequence: Synthetic polypeptide
  Variable LC G030H
DILLTQSPVILSVSPGERVSFSCRASQSIHTNIHWYQQRTNGSPRLLIKYASESISGIPSRFSGSGSGTDFTLSINSVESEDIADYYCQQNNNWPTTFGQGTKLELK

SEQ ID NO: 13534 - protein, 107 aa, Artificial Sequence
  Description of Artificial Sequence: Synthetic polypeptide
  Variable LC G030R
DILLTQSPVILSVSPGERVSFSCRASQSIRTNIHWYQQRTNGSPRLLIKYASESISGIPSRFSGSGSGTDFTLSINSVESEDIADYYCQQNNNWPTTFGQGTKLELK

SEQ ID NO: 13535 - protein, 107 aa, Artificial Sequence
  Description of Artificial Sequence: Synthetic polypeptide
  Variable LC T031A
DILLTQSPVILSVSPGERVSFSCRASQSIGANIHWYQQRTNGSPRLLIKYASESISGIPSRFSGSGSGTDFTLSINSVESEDIADYYCQQNNNWPTTFGQGTKLELK

SEQ ID NO: 13536 - protein, 107 aa, Artificial Sequence
  Description of Artificial Sequence: Synthetic polypeptide
  Variable LC T031F
DILLTQSPVILSVSPGERVSFSCRASQSIGFNIHWYQQRTNGSPRLLIKYASESISGIPSRFSGSGSGTDFTLSINSVESEDIADYYCQQNNNWPTTFGQGTKLELK

SEQ ID NO: 13537 - protein, 107 aa, Artificial Sequence
  Description of Artificial Sequence: Synthetic polypeptide
  Variable LC T031G
DILLTQSPVILSVSPGERVSFSCRASQSIGGNIHWYQQRTNGSPRLLIKYASESISGIPSRFSGSGSGTDFTLSINSVESEDIADYYCQQNNNWPTTFGQGTKLELK

SEQ ID NO: 13538 - protein, 107 aa, Artificial Sequence
  Description of Artificial Sequence: Synthetic polypeptide
  Variable LC T031M
DILLTQSPVILSVSPGERVSFSCRASQSIGMNIHWYQQRTNGSPRLLIKYASESISGIPSRFSGSGSGTDFTLSINSVESEDIADYYCQQNNNWPTTFGQGTKLELK

SEQ ID NO: 13539 - protein, 107 aa, Artificial Sequence
  Description of Artificial Sequence: Synthetic polypeptide
  Variable LC T031S
DILLTQSPVILSVSPGERVSFSCRASQSIGSNIHWYQQRTNGSPRLLIKYASESISGIPSRFSGSGSGTDFTLSINSVESEDIADYYCQQNNNWPTTFGQGTKLELK

SEQ ID NO: 13540 - protein, 107 aa, Artificial Sequence
  Description of Artificial Sequence: Synthetic polypeptide
  Variable LC T031V
DILLTQSPVILSVSPGERVSFSCRASQSIGVNIHWYQQRTNGSPRLLIKYASESISGIPSRFSGSGSGTDFTLSINSVESEDIADYYCQQNNNWPTTFGQGTKLELK

SEQ ID NO: 13541 - protein, 107 aa, Artificial Sequence
  Description of Artificial Sequence: Synthetic polypeptide
  Variable LC T031W
DILLTQSPVILSVSPGERVSFSCRASQSIGWNIHWYQQRTNGSPRLLIKYASESISGIPSRFSGSGSGTDFTLSINSVESEDIADYYCQQNNNWPTTFGQGTKLELK

SEQ ID NO: 13542 - protein, 107 aa, Artificial Sequence
  Description of Artificial Sequence: Synthetic polypeptide
  Variable LC T031L
DILLTQSPVILSVSPGERVSFSCRASQSIGLNIHWYQQRTNGSPRLLIKYASESISGIPSRFSGSGSGTDFTLSINSVESEDIADYYCQQNNNWPTTFGQGTKLELK

SEQ ID NO: 13543 - protein, 107 aa, Artificial Sequence
  Description of Artificial Sequence: Synthetic polypeptide
  Variable LC T031K
DILLTQSPVILSVSPGERVSFSCRASQSIGKNIHWYQQRTNGSPRLLIKYASESISGIPSRFSGSGSGTDFTLSINSVESEDIADYYCQQNNNWPTTFGQGTKLELK

SEQ ID NO: 13544 - protein, 107 aa, Artificial Sequence
  Description of Artificial Sequence: Synthetic polypeptide
  Variable LC T031H
DILLTQSPVILSVSPGERVSFSCRASQSIGHNIHWYQQRTNGSPRLLIKYASESISGIPSRFSGSGSGTDFTLSINSVESEDIADYYCQQNNNWPTTFGQGTKLELK

SEQ ID NO: 13545 - protein, 107 aa, Artificial Sequence
  Description of Artificial Sequence: Synthetic polypeptide
  Variable LC N032G
DILLTQSPVILSVSPGERVSFSCRASQSIGTGIHWYQQRTNGSPRLLIKYASESISGIPSRFSGSGSGTDFTLSINSVESEDIADYYCQQNNNWPTTFGQGTKLELK

SEQ ID NO: 13546 - protein, 107 aa, Artificial Sequence
  Description of Artificial Sequence: Synthetic polypeptide
  Variable LC I033F
DILLTQSPVILSVSPGERVSFSCRASQSIGTNFHWYQQRTNGSPRLLIKYASESISGIPSRFSGSGSGTDFTLSINSVESEDIADYYCQQNNNWPTTFGQGTKLELK

SEQ ID NO: 13547 - protein, 107 aa, Artificial Sequence
  Description of Artificial Sequence: Synthetic polypeptide
  Variable LC I033G
DILLTQSPVILSVSPGERVSFSCRASQSIGTNGHWYQQRTNGSPRLLIKYASESISGIPSRFSGSGSGTDFTLSINSVESEDIADYYCQQNNNWPTTFGQGTKLELK

SEQ ID NO: 13548 - protein, 107 aa, Artificial Sequence
  Description of Artificial Sequence: Synthetic polypeptide
  Variable LC I033M
DILLTQSPVILSVSPGERVSFSCRASQSIGTNMHWYQQRTNGSPRLLIKYASESISGIPSRFSGSGSGTDFTLSINSVESEDIADYYCQQNNNWPTTFGQGTKLELK

SEQ ID NO: 13549 - protein, 107 aa, Artificial Sequence
  Description of Artificial Sequence: Synthetic polypeptide
  Variable LC I033T
DILLTQSPVILSVSPGERVSFSCRASQSIGTNTHWYQQRTNGSPRLLIKYASESISGIPSRFSGSGSGTDFTLSINSVESEDIADYYCQQNNNWPTTFGQGTKLELK

SEQ ID NO: 13550 - protein, 107 aa, Artificial Sequence
  Description of Artificial Sequence: Synthetic polypeptide
  Variable LC I033V
DILLTQSPVILSVSPGERVSFSCRASQSIGTNVHWYQQRTNGSPRLLIKYASESISGIPSRFSGSGSGTDFTLSINSVESEDIADYYCQQNNNWPTTFGQGTKLELK

SEQ ID NO: 13551 - protein, 107 aa, Artificial Sequence
  Description of Artificial Sequence: Synthetic polypeptide
  Variable LC I033H
DILLTQSPVILSVSPGERVSFSCRASQSIGTNHHWYQQRTNGSPRLLIKYASESISGIPSRFSGSGSGTDFTLSINSVESEDIADYYCQQNNNWPTTFGQGTKLELK

SEQ ID NO: 13552 - protein, 107 aa, Artificial Sequence
  Description of Artificial Sequence: Synthetic polypeptide
  Variable LC I048M
DILLTQSPVILSVSPGERVSFSCRASQSIGTNIHWYQQRTNGSPRLLMKYASESISGIPSRFSGSGSGTDFTLSINSVESEDIADYYCQQNNNWPTTFGQGTKLELK

SEQ ID NO: 13553 - protein, 107 aa, Artificial Sequence
  Description of Artificial Sequence: Synthetic polypeptide
  Variable LC I048S
DILLTQSPVILSVSPGERVSFSCRASQSIGTNIHWYQQRTNGSPRLLSKYASESISGIPSRFSGSGSGTDFTLSINSVESEDIADYYCQQNNNWPTTFGQGTKLELK

SEQ ID NO: 13554 - protein, 107 aa, Artificial Sequence
  Description of Artificial Sequence: Synthetic polypeptide
  Variable LC I048L
DILLTQSPVILSVSPGERVSFSCRASQSIGTNIHWYQQRTNGSPRLLLKYASESISGIPSRFSGSGSGTDFTLSINSVESEDIADYYCQQNNNWPTTFGQGTKLELK

SEQ ID NO: 13555 - protein, 107 aa, Artificial Sequence
  Description of Artificial Sequence: Synthetic polypeptide
  Variable LC I048K
DILLTQSPVILSVSPGERVSFSCRASQSIGTNIHWYQQRTNGSPRLLKKYASESISGIPSRFSGSGSGTDFTLSINSVESEDIADYYCQQNNNWPTTFGQGTKLELK

SEQ ID NO: 13556 - protein, 107 aa, Artificial Sequence
  Description of Artificial Sequence: Synthetic polypeptide
  Variable LC K049A
DILLTQSPVILSVSPGERVSFSCRASQSIGTNIHWYQQRTNGSPRLLIAYASESISGIPSRFSGSGSGTDFTLSINSVESEDIADYYCQQNNNWPTTFGQGTKLELK

SEQ ID NO: 13557 - protein, 107 aa, Artificial Sequence
  Description of Artificial Sequence: Synthetic polypeptide
  Variable LC K049E
DILLTQSPVILSVSPGERVSFSCRASQSIGTNIHWYQQRTNGSPRLLIEYASESISGIPSRFSGSGSGTDFTLSINSVESEDIADYYCQQNNNWPTTFGQGTKLELK

SEQ ID NO: 13558 - protein, 107 aa, Artificial Sequence
  Description of Artificial Sequence: Synthetic polypeptide
  Variable LC K049F
DILLTQSPVILSVSPGERVSFSCRASQSIGTNIHWYQQRTNGSPRLLIFYASESISGIPSRFSGSGSGTDFTLSINSVESEDIADYYCQQNNNWPTTFGQGTKLELK

SEQ ID NO: 13559 - protein, 107 aa, Artificial Sequence
  Description of Artificial Sequence: Synthetic polypeptide
  Variable LC K049G
DILLTQSPVILSVSPGERVSFSCRASQSIGTNIHWYQQRTNGSPRLLIGYASESISGIPSRFSGSGSGTDFTLSINSVESEDIADYYCQQNNNWPTTFGQGTKLELK

SEQ ID NO: 13560 - protein, 107 aa, Artificial Sequence
  Description of Artificial Sequence: Synthetic polypeptide
  Variable LC K049N
DILLTQSPVILSVSPGERVSFSCRASQSIGTNIHWYQQRTNGSPRLLINYASESISGIPSRFSGSGSGTDFTLSINSVESEDIADYYCQQNNNWPTTFGQGTKLELK

SEQ ID NO: 13561 - protein, 107 aa, Artificial Sequence
  Description of Artificial Sequence: Synthetic polypeptide
  Variable LC K049Q
DILLTQSPVILSVSPGERVSFSCRASQSIGTNIHWYQQRTNGSPRLLIQYASESISGIPSRFSGSGSGTDFTLSINSVESEDIADYYCQQNNNWPTTFGQGTKLELK

SEQ ID NO: 13562 - protein, 107 aa, Artificial Sequence
  Description of Artificial Sequence: Synthetic polypeptide
  Variable LC K049S
DILLTQSPVILSVSPGERVSFSCRASQSIGTNIHWYQQRTNGSPRLLISYASESISGIPSRFSGSGSGTDFTLSINSVESEDIADYYCQQNNNWPTTFGQGTKLELK

SEQ ID NO: 13563 - protein, 107 aa, Artificial Sequence
  Description of Artificial Sequence: Synthetic polypeptide
  Variable LC K049T
DILLTQSPVILSVSPGERVSFSCRASQSIGTNIHWYQQRTNGSPRLLITYASESISGIPSRFSGSGSGTDFTLSINSVESEDIADYYCQQNNNWPTTFGQGTKLELK

SEQ ID NO: 13564 - protein, 107 aa, Artificial Sequence
  Description of Artificial Sequence: Synthetic polypeptide
  Variable LC K049V
DILLTQSPVILSVSPGERVSFSCRASQSIGTNIHWYQQRTNGSPRLLIVYASESISGIPSRFSGSGSGTDFTLSINSVESEDIADYYCQQNNNWPTTFGQGTKLELK

SEQ ID NO: 13565 - protein, 107 aa, Artificial Sequence
  Description of Artificial Sequence: Synthetic polypeptide
  Variable LC K049Y
DILLTQSPVILSVSPGERVSFSCRASQSIGTNIHWYQQRTNGSPRLLIYYASESISGIPSRFSGSGSGTDFTLSINSVESEDIADYYCQQNNNWPTTFGQGTKLELK

SEQ ID NO: 13566 - protein, 107 aa, Artificial Sequence
  Description of Artificial Sequence: Synthetic polypeptide
  Variable LC K049L
DILLTQSPVILSVSPGERVSFSCRASQSIGTNIHWYQQRTNGSPRLLILYASESISGIPSRFSGSGSGTDFTLSINSVESEDIADYYCQQNNNWPTTFGQGTKLELK

SEQ ID NO: 13567 - protein, 107 aa, Artificial Sequence
  Description of Artificial Sequence: Synthetic polypeptide
  Variable LC K049H
DILLTQSPVILSVSPGERVSFSCRASQSIGTNIHWYQQRTNGSPRLLIHYASESISGIPSRFSGSGSGTDFTLSINSVESEDIADYYCQQNNNWPTTFGQGTKLELK

SEQ ID NO: 13568 - protein, 107 aa, Artificial Sequence
  Description of Artificial Sequence: Synthetic polypeptide
  Variable LC K049R
DILLTQSPVILSVSPGERVSFSCRASQSIGTNIHWYQQRTNGSPRLLIRYASESISGIPSRFSGSGSGTDFTLSINSVESEDIADYYCQQNNNWPTTFGQGTKLELK

SEQ ID NO: 13569 - protein, 107 aa, Artificial Sequence
  Description of Artificial Sequence: Synthetic polypeptide
  Variable LC A051T
DILLTQSPVILSVSPGERVSFSCRASQSIGTNIHWYQQRTNGSPRLLIKYTSESISGIPSRFSGSGSGTDFTLSINSVESEDIADYYCQQNNNWPTTFGQGTKLELK

SEQ ID NO: 13570 - protein, 107 aa, Artificial Sequence
  Description of Artificial Sequence: Synthetic polypeptide
  Variable LC A051L
DILLTQSPVILSVSPGERVSFSCRASQSIGTNIHWYQQRTNGSPRLLIKYLSESISGIPSRFSGSGSGTDFTLSINSVESEDIADYYCQQNNNWPTTFGQGTKLELK

SEQ ID NO: 13571 - protein, 107 aa, Artificial Sequence
  Description of Artificial Sequence: Synthetic polypeptide
  Variable LC S052A
DILLTQSPVILSVSPGERVSFSCRASQSIGTNIHWYQQRTNGSPRLLIKYAAESISGIPSRFSGSGSGTDFTLSINSVESEDIADYYCQQNNNWPTTFGQGTKLELK

SEQ ID NO: 13572 - protein, 107 aa, Artificial Sequence
  Description of Artificial Sequence: Synthetic polypeptide
  Variable LC S052C
DILLTQSPVILSVSPGERVSFSCRASQSIGTNIHWYQQRTNGSPRLLIKYACESISGIPSRFSGSGSGTDFTLSINSVESEDIADYYCQQNNNWPTTFGQGTKLELK

SEQ ID NO: 13573 - protein, 107 aa, Artificial Sequence
  Description of Artificial Sequence: Synthetic polypeptide
  Variable LC S052D
DILLTQSPVILSVSPGERVSFSCRASQSIGTNIHWYQQRTNGSPRLLIKYADESISGIPSRFSGSGSGTDFTLSINSVESEDIADYYCQQNNNWPTTFGQGTKLELK

SEQ ID NO: 13574 - protein, 107 aa, Artificial Sequence
  Description of Artificial Sequence: Synthetic polypeptide
  Variable LC S052E
DILLTQSPVILSVSPGERVSFSCRASQSIGTNIHWYQQRTNGSPRLLIKYAEESISGIPSRFSGSGSGTDFTLSINSVESEDIADYYCQQNNNWPTTFGQGTKLELK

SEQ ID NO: 13575 - protein, 107 aa, Artificial Sequence
  Description of Artificial Sequence: Synthetic polypeptide
  Variable LC S052G
DILLTQSPVILSVSPGERVSFSCRASQSIGTNIHWYQQRTNGSPRLLIKYAGESISGIPSRFSGSGSGTDFTLSINSVESEDIADYYCQQNNNWPTTFGQGTKLELK

SEQ ID NO: 13576 - protein, 107 aa, Artificial Sequence
  Description of Artificial Sequence: Synthetic polypeptide
  Variable LC S052I
DILLTQSPVILSVSPGERVSFSCRASQSIGTNIHWYQQRTNGSPRLLIKYAIESISGIPSRFSGSGSGTDFTLSINSVESEDIADYYCQQNNNWPTTFGQGTKLELK

SEQ ID NO: 13577 - protein, 107 aa, Artificial Sequence
  Description of Artificial Sequence: Synthetic polypeptide
  Variable LC S052M
DILLTQSPVILSVSPGERVSFSCRASQSIGTNIHWYQQRTNGSPRLLIKYAMESISGIPSRFSGSGSGTDFTLSINSVESEDIADYYCQQNNNWPTTFGQGTKLELK

SEQ ID NO: 13578 - protein, 107 aa, Artificial Sequence
  Description of Artificial Sequence: Synthetic polypeptide
  Variable LC S052Q
DILLTQSPVILSVSPGERVSFSCRASQSIGTNIHWYQQRTNGSPRLLIKYAQESISGIPSRFSGSGSGTDFTLSINSVESEDIADYYCQQNNNWPTTFGQGTKLELK

SEQ ID NO: 13579 - protein, 107 aa, Artificial Sequence
  Description of Artificial Sequence: Synthetic polypeptide
  Variable LC S052V
DILLTQSPVILSVSPGERVSFSCRASQSIGTNIHWYQQRTNGSPRLLIKYAVESISGIPSRFSGSGSGTDFTLSINSVESEDIADYYCQQNNNWPTTFGQGTKLELK

SEQ ID NO: 13580 - protein, 107 aa, Artificial Sequence
  Description of Artificial Sequence: Synthetic polypeptide
  Variable LC S052W
DILLTQSPVILSVSPGERVSFSCRASQSIGTNIHWYQQRTNGSPRLLIKYAWESISGIPSRFSGSGSGTDFTLSINSVESEDIADYYCQQNNNWPTTFGQGTKLELK

SEQ ID NO: 13581 - protein, 107 aa, Artificial Sequence
  Description of Artificial Sequence: Synthetic polypeptide
  Variable LC S052R
DILLTQSPVILSVSPGERVSFSCRASQSIGTNIHWYQQRTNGSPRLLIKYARESISGIPSRFSGSGSGTDFTLSINSVESEDIADYYCQQNNNWPTTFGQGTKLELK

SEQ ID NO: 13582 - protein, 107 aa, Artificial Sequence
  Description of Artificial Sequence: Synthetic polypeptide
  Variable LC S052K
DILLTQSPVILSVSPGERVSFSCRASQSIGTNIHWYQQRTNGSPRLLIKYAKESISGIPSRFSGSGSGTDFTLSINSVESEDIADYYCQQNNNWPTTFGQGTKLELK

SEQ ID NO: 13583 - protein, 107 aa, Artificial Sequence
  Description of Artificial Sequence: Synthetic polypeptide
  Variable LC E053G
DILLTQSPVILSVSPGERVSFSCRASQSIGTNIHWYQQRTNGSPRLLIKYASGSISGIPSRFSGSGSGTDFTLSINSVESEDIADYYCQQNNNWPTTFGQGTKLELK

SEQ ID NO: 13584 - protein, 107 aa, Artificial Sequence
  Description of Artificial Sequence: Synthetic polypeptide
  Variable LC S054M
DILLTQSPVILSVSPGERVSFSCRASQSIGTNIHWYQQRTNGSPRLLIKYASEMISGIPSRFSGSGSGTDFTLSINSVESEDIADYYCQQNNNWPTTFGQGTKLELK

SEQ ID NO: 13585 - protein, 107 aa, Artificial Sequence
  Description of Artificial Sequence: Synthetic polypeptide
  Variable LC I055A
DILLTQSPVILSVSPGERVSFSCRASQSIGTNIHWYQQRTNGSPRLLIKYASESASGIPSRFSGSGSGTDFTLSINSVESEDIADYYCQQNNNWPTTFGQGTKLELK

SEQ ID NO: 13586 - protein, 107 aa, Artificial Sequence
  Description of Artificial Sequence: Synthetic polypeptide
  Variable LC I055F
DILLTQSPVILSVSPGERVSFSCRASQSIGTNIHWYQQRTNGSPRLLIKYASESFSGIPSRFSGSGSGTDFTLSINSVESEDIADYYCQQNNNWPTTFGQGTKLELK

SEQ ID NO: 13587 - protein, 107 aa, Artificial Sequence
  Description of Artificial Sequence: Synthetic polypeptide
  Variable LC S056G
DILLTQSPVILSVSPGERVSFSCRASQSIGTNIHWYQQRTNGSPRLLIKYASESIGGIPSRFSGSGSGTDFTLSINSVESEDIADYYCQQNNNWPTTFGQGTKLELK

SEQ ID NO: 13588 - protein, 107 aa, Artificial Sequence
  Description of Artificial Sequence: Synthetic polypeptide
  Variable LC S056L
DILLTQSPVILSVSPGERVSFSCRASQSIGTNIHWYQQRTNGSPRLLIKYASESILGIPSRFSGSGSGTDFTLSINSVESEDIADYYCQQNNNWPTTFGQGTKLELK

SEQ ID NO: 13589 - protein, 107 aa, Artificial Sequence
  Description of Artificial Sequence: Synthetic polypeptide
  Variable LC S056A
DILLTQSPVILSVSPGERVSFSCRASQSIGTNIHWYQQRTNGSPRLLIKYASESIAGIPSRFSGSGSGTDFTLSINSVESEDIADYYCQQNNNWPTTFGQGTKLELK

SEQ ID NO: 13590 - protein, 107 aa, Artificial Sequence
  Description of Artificial Sequence: Synthetic polypeptide
  Variable LC S056C
DILLTQSPVILSVSPGERVSFSCRASQSIGTNIHWYQQRTNGSPRLLIKYASESICGIPSRFSGSGSGTDFTLSINSVESEDIADYYCQQNNNWPTTFGQGTKLELK

SEQ ID NO: 13591 - protein, 107 aa, Artificial Sequence
  Description of Artificial Sequence: Synthetic polypeptide
  Variable LC S056D
DILLTQSPVILSVSPGERVSFSCRASQSIGTNIHWYQQRTNGSPRLLIKYASESIDGIPSRFSGSGSGTDFTLSINSVESEDIADYYCQQNNNWPTTFGQGTKLELK

SEQ ID NO: 13592 - protein, 107 aa, Artificial Sequence
  Description of Artificial Sequence: Synthetic polypeptide
  Variable LC S056E
DILLTQSPVILSVSPGERVSFSCRASQSIGTNIHWYQQRTNGSPRLLIKYASESIEGIPSRFSGSGSGTDFTLSINSVESEDIADYYCQQNNNWPTTFGQGTKLELK

SEQ ID NO: 13593 - protein, 107 aa, Artificial Sequence
  Description of Artificial Sequence: Synthetic polypeptide
  Variable LC S056F
DILLTQSPVILSVSPGERVSFSCRASQSIGTNIHWYQQRTNGSPRLLIKYASESIFGIPSRFSGSGSGTDFTLSINSVESEDIADYYCQQNNNWPTTFGQGTKLELK

SEQ ID NO: 13594 - protein, 107 aa, Artificial Sequence
  Description of Artificial Sequence: Synthetic polypeptide
  Variable LC S056N
DILLTQSPVILSVSPGERVSFSCRASQSIGTNIHWYQQRTNGSPRLLIKYASESINGIPSRFSGSGSGTDFTLSINSVESEDIADYYCQQNNNWPTTFGQGTKLELK

SEQ ID NO: 13595 - protein, 107 aa, Artificial Sequence
  Description of Artificial Sequence: Synthetic polypeptide
  Variable LC S056P
DILLTQSPVILSVSPGERVSFSCRASQSIGTNIHWYQQRTNGSPRLLIKYASESIPGIPSRFSGSGSGTDFTLSINSVESEDIADYYCQQNNNWPTTFGQGTKLELK

SEQ ID NO: 13596 - protein, 107 aa, Artificial Sequence
  Description of Artificial Sequence: Synthetic polypeptide
  Variable LC S056Q
DILLTQSPVILSVSPGERVSFSCRASQSIGTNIHWYQQRTNGSPRLLIKYASESIQGIPSRFSGSGSGTDFTLSINSVESEDIADYYCQQNNNWPTTFGQGTKLELK

SEQ ID NO: 13597 - protein, 107 aa, Artificial Sequence
  Description of Artificial Sequence: Synthetic polypeptide
  Variable LC S056V
DILLTQSPVILSVSPGERVSFSCRASQSIGTNIHWYQQRTNGSPRLLIKYASESIVGIPSRFSGSGSGTDFTLSINSVESEDIADYYCQQNNNWPTTFGQGTKLELK

SEQ ID NO: 13598 - protein, 107 aa, Artificial Sequence
  Description of Artificial Sequence: Synthetic polypeptide
  Variable LC S056W
DILLTQSPVILSVSPGERVSFSCRASQSIGTNIHWYQQRTNGSPRLLIKYASESIWGIPSRFSGSGSGTDFTLSINSVESEDIADYYCQQNNNWPTTFGQGTKLELK

SEQ ID NO: 13599 - protein, 107 aa, Artificial Sequence
  Description of Artificial Sequence: Synthetic polypeptide
  Variable LC S056H
DILLTQSPVILSVSPGERVSFSCRASQSIGTNIHWYQQRTNGSPRLLIKYASESIHGIPSRFSGSGSGTDFTLSINSVESEDIADYYCQQNNNWPTTFGQGTKLELK

SEQ ID NO: 13600 - protein, 107 aa, Artificial Sequence
  Description of Artificial Sequence: Synthetic polypeptide
  Variable LC S056R
DILLTQSPVILSVSPGERVSFSCRASQSIGTNIHWYQQRTNGSPRLLIKYASESIRGIPSRFSGSGSGTDFTLSINSVESEDIADYYCQQNNNWPTTFGQGTKLELK

SEQ ID NO: 13601 - protein, 107 aa, Artificial Sequence
  Description of Artificial Sequence: Synthetic polypeptide
  Variable LC S056K
DILLTQSPVILSVSPGERVSFSCRASQSIGTNIHWYQQRTNGSPRLLIKYASESIKGIPSRFSGSGSGTDFTLSINSVESEDIADYYCQQNNNWPTTFGQGTKLELK

SEQ ID NO: 13602 - protein, 107 aa, Artificial Sequence
  Description of Artificial Sequence: Synthetic polypeptide
  Variable LC Y086F
DILLTQSPVILSVSPGERVSFSCRASQSIGTNIHWYQQRTNGSPRLLIKYASESISGIPSRFSGSGSGTDFTLSINSVESEDIADFYCQQNNNWPTTFGQGTKLELK

SEQ ID NO: 13603 - protein, 107 aa, Artificial Sequence
  Description of Artificial Sequence: Synthetic polypeptide
  Variable LC Y086M
DILLTQSPVILSVSPGERVSFSCRASQSIGTNIHWYQQRTNGSPRLLIKYASESISGIPSRFSGSGSGTDFTLSINSVESEDIADMYCQQNNNWPTTFGQGTKLELK

SEQ ID NO: 13604 - protein, 107 aa, Artificial Sequence
  Description of Artificial Sequence: Synthetic polypeptide
  Variable LC Y086H
DILLTQSPVILSVSPGERVSFSCRASQSIGTNIHWYQQRTNGSPRLLIKYASESISGIPSRFSGSGSGTDFTLSINSVESEDIADHYCQQNNNWPTTFGQGTKLELK

SEQ ID NO: 13605 - protein, 107 aa, Artificial Sequence
  Description of Artificial Sequence: Synthetic polypeptide
  Variable LC Y087L
DILLTQSPVILSVSPGERVSFSCRASQSIGTNIHWYQQRTNGSPRLLIKYASESISGIPSRFSGSGSGTDFTLSINSVESEDIADYLCQQNNNWPTTFGQGTKLELK

SEQ ID NO: 13606 - protein, 107 aa, Artificial Sequence
  Description of Artificial Sequence: Synthetic polypeptide
  Variable LC Y087C
DILLTQSPVILSVSPGERVSFSCRASQSIGTNIHWYQQRTNGSPRLLIKYASESISGIPSRFSGSGSGTDFTLSINSVESEDIADYCCQQNNNWPTTFGQGTKLELK

SEQ ID NO: 13607 - protein, 107 aa, Artificial Sequence
  Description of Artificial Sequence: Synthetic polypeptide
  Variable LC Y087D
DILLTQSPVILSVSPGERVSFSCRASQSIGTNIHWYQQRTNGSPRLLIKYASESISGIPSRFSGSGSGTDFTLSINSVESEDIADYDCQQNNNWPTTFGQGTKLELK

SEQ ID NO: 13608 - protein, 107 aa, Artificial Sequence
  Description of Artificial Sequence: Synthetic polypeptide
  Variable LC Y087F
DILLTQSPVILSVSPGERVSFSCRASQSIGTNIHWYQQRTNGSPRLLIKYASESISGIPSRFSGSGSGTDFTLSINSVESEDIADYFCQQNNNWPTTFGQGTKLELK

SEQ ID NO: 13609 - protein, 107 aa, Artificial Sequence
  Description of Artificial Sequence: Synthetic polypeptide
  Variable LC Y087G
DILLTQSPVILSVSPGERVSFSCRASQSIGTNIHWYQQRTNGSPRLLIKYASESISGIPSRFSGSGSGTDFTLSINSVESEDIADYGCQQNNNWPTTFGQGTKLELK

SEQ ID NO: 13610 - protein, 107 aa, Artificial Sequence
  Description of Artificial Sequence: Synthetic polypeptide
  Variable LC Y087I
DILLTQSPVILSVSPGERVSFSCRASQSIGTNIHWYQQRTNGSPRLLIKYASESISGIPSRFSGSGSGTDFTLSINSVESEDIADYICQQNNNWPTTFGQGTKLELK

SEQ ID NO: 13611 - protein, 107 aa, Artificial Sequence
  Description of Artificial Sequence: Synthetic polypeptide
  Variable LC Y087N
DILLTQSPVILSVSPGERVSFSCRASQSIGTNIHWYQQRTNGSPRLLIKYASESISGIPSRFSGSGSGTDFTLSINSVESEDIADYNCQQNNNWPTTFGQGTKLELK

SEQ ID NO: 13612 - protein, 107 aa, Artificial Sequence
  Description of Artificial Sequence: Synthetic polypeptide
  Variable LC Y087P
DILLTQSPVILSVSPGERVSFSCRASQSIGTNIHWYQQRTNGSPRLLIKYASESISGIPSRFSGSGSGTDFTLSINSVESEDIADYPCQQNNNWPTTFGQGTKLELK

SEQ ID NO: 13613 - protein, 107 aa, Artificial Sequence
  Description of Artificial Sequence: Synthetic polypeptide
  Variable LC Y087S
DILLTQSPVILSVSPGERVSFSCRASQSIGTNIHWYQQRTNGSPRLLIKYASESISGIPSRFSGSGSGTDFTLSINSVESEDIADYSCQQNNNWPTTFGQGTKLELK

SEQ ID NO: 13614 - protein, 107 aa, Artificial Sequence
  Description of Artificial Sequence: Synthetic polypeptide
  Variable LC Y087T
DILLTQSPVILSVSPGERVSFSCRASQSIGTNIHWYQQRTNGSPRLLIKYASESISGIPSRFSGSGSGTDFTLSINSVESEDIADYTCQQNNNWPTTFGQGTKLELK

SEQ ID NO: 13615 - protein, 107 aa, Artificial Sequence
  Description of Artificial Sequence: Synthetic polypeptide
  Variable LC Y087V
DILLTQSPVILSVSPGERVSFSCRASQSIGTNIHWYQQRTNGSPRLLIKYASESISGIPSRFSGSGSGTDFTLSINSVESEDIADYVCQQNNNWPTTFGQGTKLELK

SEQ ID NO: 13616 - protein, 107 aa, Artificial Sequence
  Description of Artificial Sequence: Synthetic polypeptide
  Variable LC Y087W
DILLTQSPVILSVSPGERVSFSCRASQSIGTNIHWYQQRTNGSPRLLIKYASESISGIPSRFSGSGSGTDFTLSINSVESEDIADYWCQQNNNWPTTFGQGTKLELK

SEQ ID NO: 13617 - protein, 107 aa, Artificial Sequence
  Description of Artificial Sequence: Synthetic polypeptide
  Variable LC Y087K
DILLTQSPVILSVSPGERVSFSCRASQSIGTNIHWYQQRTNGSPRLLIKYASESISGIPSRFSGSGSGTDFTLSINSVESEDIADYKCQQNNNWPTTFGQGTKLELK

SEQ ID NO: 13618 - protein, 107 aa, Artificial Sequence
  Description of Artificial Sequence: Synthetic polypeptide
  Variable LC Y087H
DILLTQSPVILSVSPGERVSFSCRASQSIGTNIHWYQQRTNGSPRLLIKYASESISGIPSRFSGSGSGTDFTLSINSVESEDIADYHCQQNNNWPTTFGQGTKLELK

SEQ ID NO: 13619 - protein, 107 aa, Artificial Sequence
  Description of Artificial Sequence: Synthetic polypeptide
  Variable LC Y087R
DILLTQSPVILSVSPGERVSFSCRASQSIGTNIHWYQQRTNGSPRLLIKYASESISGIPSRFSGSGSGTDFTLSINSVESEDIADYRCQQNNNWPTTFGQGTKLELK

SEQ ID NO: 13620 - protein, 107 aa, Artificial Sequence
  Description of Artificial Sequence: Synthetic polypeptide
  Variable LC Q089E
DILLTQSPVILSVSPGERVSFSCRASQSIGTNIHWYQQRTNGSPRLLIKYASESISGIPSRFSGSGSGTDFTLSINSVESEDIADYYCEQNNNWPTTFGQGTKLELK

SEQ ID NO: 13621 - protein, 107 aa, Artificial Sequence
  Description of Artificial Sequence: Synthetic polypeptide
  Variable LC N091L
DILLTQSPVILSVSPGERVSFSCRASQSIGTNIHWYQQRTNGSPRLLIKYASESISGIPSRFSGSGSGTDFTLSINSVESEDIADYYCQQLNNWPTTFGQGTKLELK

SEQ ID NO: 13622 - protein, 107 aa, Artificial Sequence
  Description of Artificial Sequence: Synthetic polypeptide
  Variable LC N091A
DILLTQSPVILSVSPGERVSFSCRASQSIGTNIHWYQQRTNGSPRLLIKYASESISGIPSRFSGSGSGTDFTLSINSVESEDIADYYCQQANNWPTTFGQGTKLELK

SEQ ID NO: 13623 - protein, 107 aa, Artificial Sequence
  Description of Artificial Sequence: Synthetic polypeptide
  Variable LC N091C
DILLTQSPVILSVSPGERVSFSCRASQSIGTNIHWYQQRTNGSPRLLIKYASESISGIPSRFSGSGSGTDFTLSINSVESEDIADYYCQQCNNWPTTFGQGTKLELK

SEQ ID NO: 13624 - protein, 107 aa, Artificial Sequence
  Description of Artificial Sequence: Synthetic polypeptide
  Variable LC N091I
DILLTQSPVILSVSPGERVSFSCRASQSIGTNIHWYQQRTNGSPRLLIKYASESISGIPSRFSGSGSGTDFTLSINSVESEDIADYYCQQINNWPTTFGQGTKLELK

SEQ ID NO: 13625 - protein, 107 aa, Artificial Sequence
  Description of Artificial Sequence: Synthetic polypeptide
  Variable LC N091M
DILLTQSPVILSVSPGERVSFSCRASQSIGTNIHWYQQRTNGSPRLLIKYASESISGIPSRFSGSGSGTDFTLSINSVESEDIADYYCQQMNNWPTTFGQGTKLELK

SEQ ID NO: 13626 - protein, 107 aa, Artificial Sequence
  Description of Artificial Sequence: Synthetic polypeptide
  Variable LC N091S
DILLTQSPVILSVSPGERVSFSCRASQSIGTNIHWYQQRTNGSPRLLIKYASESISGIPSRFSGSGSGTDFTLSINSVESEDIADYYCQQSNNWPTTFGQGTKLELK

SEQ ID NO: 13627 - protein, 107 aa, Artificial Sequence
  Description of Artificial Sequence: Synthetic polypeptide
  Variable LC N091T
DILLTQSPVILSVSPGERVSFSCRASQSIGTNIHWYQQRTNGSPRLLIKYASESISGIPSRFSGSGSGTDFTLSINSVESEDIADYYCQQTNNWPTTFGQGTKLELK

SEQ ID NO: 13628 - protein, 107 aa, Artificial Sequence
  Description of Artificial Sequence: Synthetic polypeptide
  Variable LC N091V
DILLTQSPVILSVSPGERVSFSCRASQSIGTNIHWYQQRTNGSPRLLIKYASESISGIPSRFSGSGSGTDFTLSINSVESEDIADYYCQQVNNWPTTFGQGTKLELK

SEQ ID NO: 13629 - protein, 107 aa, Artificial Sequence
  Description of Artificial Sequence: Synthetic polypeptide
  Variable LC N091H
DILLTQSPVILSVSPGERVSFSCRASQSIGTNIHWYQQRTNGSPRLLIKYASESISGIPSRFSGSGSGTDFTLSINSVESEDIADYYCQQHNNWPTTFGQGTKLELK

SEQ ID NO: 13630 - protein, 107 aa, Artificial Sequence
  Description of Artificial Sequence: Synthetic polypeptide
  Variable LC N091R
DILLTQSPVILSVSPGERVSFSCRASQSIGTNIHWYQQRTNGSPRLLIKYASESISGIPSRFSGSGSGTDFTLSINSVESEDIADYYCQQRNNWPTTFGQGTKLELK

SEQ ID NO: 13631 - protein, 107 aa, Artificial Sequence
  Description of Artificial Sequence: Synthetic polypeptide
  Variable LC N092C
DILLTQSPVILSVSPGERVSFSCRASQSIGTNIHWYQQRTNGSPRLLIKYASESISGIPSRFSGSGSGTDFTLSINSVESEDIADYYCQQNCNWPTTFGQGTKLELK

SEQ ID NO: 13632 - protein, 107 aa, Artificial Sequence
  Description of Artificial Sequence: Synthetic polypeptide
  Variable LC N092D
DILLTQSPVILSVSPGERVSFSCRASQSIGTNIHWYQQRTNGSPRLLIKYASESISGIPSRFSGSGSGTDFTLSINSVESEDIADYYCQQNDNWPTTFGQGTKLELK

SEQ ID NO: 13633 - protein, 107 aa, Artificial Sequence
  Description of Artificial Sequence: Synthetic polypeptide
  Variable LC N092L
DILLTQSPVILSVSPGERVSFSCRASQSIGTNIHWYQQRTNGSPRLLIKYASESISGIPSRFSGSGSGTDFTLSINSVESEDIADYYCQQNLNWPTTFGQGTKLELK

SEQ ID NO: 13634 - protein, 107 aa, Artificial Sequence
  Description of Artificial Sequence: Synthetic polypeptide
  Variable LC N092M
DILLTQSPVILSVSPGERVSFSCRASQSIGTNIHWYQQRTNGSPRLLIKYASESISGIPSRFSGSGSGTDFTLSINSVESEDIADYYCQQNMNWPTTFGQGTKLELK

SEQ ID NO: 13635 - protein, 107 aa, Artificial Sequence
  Description of Artificial Sequence: Synthetic polypeptide
  Variable LC N092S
DILLTQSPVILSVSPGERVSFSCRASQSIGTNIHWYQQRTNGSPRLLIKYASESISGIPSRFSGSGSGTDFTLSINSVESEDIADYYCQQNSNWPTTFGQGTKLELK

SEQ ID NO: 13636 - protein, 107 aa, Artificial Sequence
  Description of Artificial Sequence: Synthetic polypeptide
  Variable LC N092T
DILLTQSPVILSVSPGERVSFSCRASQSIGTNIHWYQQRTNGSPRLLIKYASESISGIPSRFSGSGSGTDFTLSINSVESEDIADYYCQQNTNWPTTFGQGTKLELK

SEQ ID NO: 13637 - protein, 107 aa, Artificial Sequence
  Description of Artificial Sequence: Synthetic polypeptide
  Variable LC N092V
DILLTQSPVILSVSPGERVSFSCRASQSIGTNIHWYQQRTNGSPRLLIKYASESISGIPSRFSGSGSGTDFTLSINSVESEDIADYYCQQNVNWPTTFGQGTKLELK

SEQ ID NO: 13638 - protein, 107 aa, Artificial Sequence
  Description of Artificial Sequence: Synthetic polypeptide
  Variable LC N092W
DILLTQSPVILSVSPGERVSFSCRASQSIGTNIHWYQQRTNGSPRLLIKYASESISGIPSRFSGSGSGTDFTLSINSVESEDIADYYCQQNWNWPTTFGQGTKLELK

SEQ ID NO: 13639 - protein, 107 aa, Artificial Sequence
  Description of Artificial Sequence: Synthetic polypeptide
  Variable LC N092Y
DILLTQSPVILSVSPGERVSFSCRASQSIGTNIHWYQQRTNGSPRLLIKYASESISGIPSRFSGSGSGTDFTLSINSVESEDIADYYCQQNYNWPTTFGQGTKLELK

SEQ ID NO: 13640 - protein, 107 aa, Artificial Sequence
  Description of Artificial Sequence: Synthetic polypeptide
  Variable LC N092H
DILLTQSPVILSVSPGERVSFSCRASQSIGTNIHWYQQRTNGSPRLLIKYASESISGIPSRFSGSGSGTDFTLSINSVESEDIADYYCQQNHNWPTTFGQGTKLELK

SEQ ID NO: 13641 - protein, 107 aa, Artificial Sequence
  Description of Artificial Sequence: Synthetic polypeptide
  Variable LC N092K
DILLTQSPVILSVSPGERVSFSCRASQSIGTNIHWYQQRTNGSPRLLIKYASESISGIPSRFSGSGSGTDFTLSINSVESEDIADYYCQQNKNWPTTFGQGTKLELK

SEQ ID NO: 13642 - protein, 107 aa, Artificial Sequence
  Description of Artificial Sequence: Synthetic polypeptide
  Variable LC N092R
DILLTQSPVILSVSPGERVSFSCRASQSIGTNIHWYQQRTNGSPRLLIKYASESISGIPSRFSGSGSGTDFTLSINSVESEDIADYYCQQNRNWPTTFGQGTKLELK

SEQ ID NO: 13643 - protein, 107 aa, Artificial Sequence
  Description of Artificial Sequence: Synthetic polypeptide
  Variable LC N093T
DILLTQSPVILSVSPGERVSFSCRASQSIGTNIHWYQQRTNGSPRLLIKYASESISGIPSRFSGSGSGTDFTLSINSVESEDIADYYCQQNNTWPTTFGQGTKLELK

SEQ ID NO: 13644 - protein, 107 aa, Artificial Sequence
  Description of Artificial Sequence: Synthetic polypeptide
  Variable LC T096L
DILLTQSPVILSVSPGERVSFSCRASQSIGTNIHWYQQRTNGSPRLLIKYASESISGIPSRFSGSGSGTDFTLSINSVESEDIADYYCQQNNNWPLTFGQGTKLELK

SEQ ID NO: 13645 - protein, 107 aa, Artificial Sequence
  Description of Artificial Sequence: Synthetic polypeptide
  Variable LC T096C
DILLTQSPVILSVSPGERVSFSCRASQSIGTNIHWYQQRTNGSPRLLIKYASESISGIPSRFSGSGSGTDFTLSINSVESEDIADYYCQQNNNWPCTFGQGTKLELK

SEQ ID NO: 13646 - protein, 107 aa, Artificial Sequence
  Description of Artificial Sequence: Synthetic polypeptide
  Variable LC T096M
DILLTQSPVILSVSPGERVSFSCRASQSIGTNIHWYQQRTNGSPRLLIKYASESISGIPSRFSGSGSGTDFTLSINSVESEDIADYYCQQNNNWPMTFGQGTKLELK

SEQ ID NO: 13647 - protein, 107 aa, Artificial Sequence
  Description of Artificial Sequence: Synthetic polypeptide
  Variable LC T096V
DILLTQSPVILSVSPGERVSFSCRASQSIGTNIHWYQQRTNGSPRLLIKYASESISGIPSRFSGSGSGTDFTLSINSVESEDIADYYCQQNNNWPVTFGQGTKLELK

SEQ ID NO: 13648 - protein, 107 aa, Artificial Sequence
  Description of Artificial Sequence: Synthetic polypeptide
  Variable LC T097L
DILLTQSPVILSVSPGERVSFSCRASQSIGTNIHWYQQRTNGSPRLLIKYASESISGIPSRFSGSGSGTDFTLSINSVESEDIADYYCQQNNNWPTLFGQGTKLELK

SEQ ID NO: 13649 - protein, 107 aa, Artificial Sequence
  Description of Artificial Sequence: Synthetic polypeptide
  Variable LC T097A
DILLTQSPVILSVSPGERVSFSCRASQSIGTNIHWYQQRTNGSPRLLIKYASESISGIPSRFSGSGSGTDFTLSINSVESEDIADYYCQQNNNWPTAFGQGTKLELK

SEQ ID NO: 13650 - protein, 107 aa, Artificial Sequence
  Description of Artificial Sequence: Synthetic polypeptide
  Variable LC T097D
DILLTQSPVILSVSPGERVSFSCRASQSIGTNIHWYQQRTNGSPRLLIKYASESISGIPSRFSGSGSGTDFTLSINSVESEDIADYYCQQNNNWPTDFGQGTKLELK

SEQ ID NO: 13651 - protein, 107 aa, Artificial Sequence
  Description of Artificial Sequence: Synthetic polypeptide
  Variable LC T097G
DILLTQSPVILSVSPGERVSFSCRASQSIGTNIHWYQQRTNGSPRLLIKYASESISGIPSRFSGSGSGTDFTLSINSVESEDIADYYCQQNNNWPTGFGQGTKLELK

SEQ ID NO: 13652 - protein, 107 aa, Artificial Sequence
  Description of Artificial Sequence: Synthetic polypeptide
  Variable LC T097Q
DILLTQSPVILSVSPGERVSFSCRASQSIGTNIHWYQQRTNGSPRLLIKYASESISGIPSRFSGSGSGTDFTLSINSVESEDIADYYCQQNNNWPTQFGQGTKLELK

SEQ ID NO: 13653 - protein, 107 aa, Artificial Sequence
  Description of Artificial Sequence: Synthetic polypeptide
  Variable LC T097S
DILLTQSPVILSVSPGERVSFSCRASQSIGTNIHWYQQRTNGSPRLLIKYASESISGIPSRFSGSGSGTDFTLSINSVESEDIADYYCQQNNNWPTSFGQGTKLELK

SEQ ID NO: 13654 - protein, 107 aa, Artificial Sequence
  Description of Artificial Sequence: Synthetic polypeptide
  Variable LC T097V
DILLTQSPVILSVSPGERVSFSCRASQSIGTNIHWYQQRTNGSPRLLIKYASESISGIPSRFSGSGSGTDFTLSINSVESEDIADYYCQQNNNWPTVFGQGTKLELK

SEQ ID NO: 13655 - protein, 107 aa, Artificial Sequence
  Description of Artificial Sequence: Synthetic polypeptide
  Variable LC T097K
DILLTQSPVILSVSPGERVSFSCRASQSIGTNIHWYQQRTNGSPRLLIKYASESISGIPSRFSGSGSGTDFTLSINSVESEDIADYYCQQNNNWPTKFGQGTKLELK

SEQ ID NO: 13656 - protein, 107 aa, Artificial Sequence
  Description of Artificial Sequence: Synthetic polypeptide
  Variable LC T097R
DILLTQSPVILSVSPGERVSFSCRASQSIGTNIHWYQQRTNGSPRLLIKYASESISGIPSRFSGSGSGTDFTLSINSVESEDIADYYCQQNNNWPTRFGQGTKLELK

SEQ ID NO: 13657 - protein, 107 aa, Artificial Sequence
  Description of Artificial Sequence: Synthetic polypeptide
  Variable LC F098A
DILLTQSPVILSVSPGERVSFSCRASQSIGTNIHWYQQRTNGSPRLLIKYASESISGIPSRFSGSGSGTDFTLSINSVESEDIADYYCQQNNNWPTTAGQGTKLELK

SEQ ID NO: 13658 - protein, 107 aa, Artificial Sequence
  Description of Artificial Sequence: Synthetic polypeptide
  Variable LC F098M
DILLTQSPVILSVSPGERVSFSCRASQSIGTNIHWYQQRTNGSPRLLIKYASESISGIPSRFSGSGSGTDFTLSINSVESEDIADYYCQQNNNWPTTMGQGTKLELK

SEQ ID NO: 13659 - protein, 107 aa, Artificial Sequence
  Description of Artificial Sequence: Synthetic polypeptide
  Variable LC F098S
DILLTQSPVILSVSPGERVSFSCRASQSIGTNIHWYQQRTNGSPRLLIKYASESISGIPSRFSGSGSGTDFTLSINSVESEDIADYYCQQNNNWPTTSGQGTKLELK

SEQ ID NO: 13660 - protein, 107 aa, Artificial Sequence
  Description of Artificial Sequence: Synthetic polypeptide
  Variable LC F098V
DILLTQSPVILSVSPGERVSFSCRASQSIGTNIHWYQQRTNGSPRLLIKYASESISGIPSRFSGSGSGTDFTLSINSVESEDIADYYCQQNNNWPTTVGQGTKLELK

SEQ ID NO: 13661 - protein, 107 aa, Artificial Sequence
  Description of Artificial Sequence: Synthetic polypeptide
  Variable LC F098Y
DILLTQSPVILSVSPGERVSFSCRASQSIGTNIHWYQQRTNGSPRLLIKYASESISGIPSRFSGSGSGTDFTLSINSVESEDIADYYCQQNNNWPTTYGQGTKLELK

SEQ ID NO: 13662 - protein, 107 aa, Artificial Sequence
  Description of Artificial Sequence: Synthetic polypeptide
  Variable LC G099L
DILLTQSPVILSVSPGERVSFSCRASQSIGTNIHWYQQRTNGSPRLLIKYASESISGIPSRFSGSGSGTDFTLSINSVESEDIADYYCQQNNNWPTTFLQGTKLELK

SEQ ID NO: 13663 - protein, 107 aa, Artificial Sequence
  Description of Artificial Sequence: Synthetic polypeptide
  Variable LC G099D
DILLTQSPVILSVSPGERVSFSCRASQSIGTNIHWYQQRTNGSPRLLIKYASESISGIPSRFSGSGSGTDFTLSINSVESEDIADYYCQQNNNWPTTFDQGTKLELK

SEQ ID NO: 13664 - protein, 107 aa, Artificial Sequence
  Description of Artificial Sequence: Synthetic polypeptide
  Variable LC G099E
DILLTQSPVILSVSPGERVSFSCRASQSIGTNIHWYQQRTNGSPRLLIKYASESISGIPSRFSGSGSGTDFTLSINSVESEDIADYYCQQNNNWPTTFEQGTKLELK

SEQ ID NO: 13665 - protein, 107 aa, Artificial Sequence
  Description of Artificial Sequence: Synthetic polypeptide
  Variable LC G099F
DILLTQSPVILSVSPGERVSFSCRASQSIGTNIHWYQQRTNGSPRLLIKYASESISGIPSRFSGSGSGTDFTLSINSVESEDIADYYCQQNNNWPTTFFQGTKLELK

SEQ ID NO: 13666 - protein, 107 aa, Artificial Sequence
  Description of Artificial Sequence: Synthetic polypeptide
  Variable LC G099I
DILLTQSPVILSVSPGERVSFSCRASQSIGTNIHWYQQRTNGSPRLLIKYASESISGIPSRFSGSGSGTDFTLSINSVESEDIADYYCQQNNNWPTTFIQGTKLELK

SEQ ID NO: 13667 - protein, 107 aa, Artificial Sequence
  Description of Artificial Sequence: Synthetic polypeptide
  Variable LC G099M
DILLTQSPVILSVSPGERVSFSCRASQSIGTNIHWYQQRTNGSPRLLIKYASESISGIPSRFSGSGSGTDFTLSINSVESEDIADYYCQQNNNWPTTFMQGTKLELK

SEQ ID NO: 13668 - protein, 107 aa, Artificial Sequence
  Description of Artificial Sequence: Synthetic polypeptide
  Variable LC G099N
DILLTQSPVILSVSPGERVSFSCRASQSIGTNIHWYQQRTNGSPRLLIKYASESISGIPSRFSGSGSGTDFTLSINSVESEDIADYYCQQNNNWPTTFNQGTKLELK

SEQ ID NO: 13669 - protein, 107 aa, Artificial Sequence
  Description of Artificial Sequence: Synthetic polypeptide
  Variable LC G099S
DILLTQSPVILSVSPGERVSFSCRASQSIGTNIHWYQQRTNGSPRLLIKYASESISGIPSRFSGSGSGTDFTLSINSVESEDIADYYCQQNNNWPTTFSQGTKLELK

SEQ ID NO: 13670 - protein, 107 aa, Artificial Sequence
  Description of Artificial Sequence: Synthetic polypeptide
  Variable LC G099T
DILLTQSPVILSVSPGERVSFSCRASQSIGTNIHWYQQRTNGSPRLLIKYASESISGIPSRFSGSGSGTDFTLSINSVESEDIADYYCQQNNNWPTTFTQGTKLELK

SEQ ID NO: 13671 - protein, 107 aa, Artificial Sequence
  Description of Artificial Sequence: Synthetic polypeptide
  Variable LC G099V
DILLTQSPVILSVSPGERVSFSCRASQSIGTNIHWYQQRTNGSPRLLIKYASESISGIPSRFSGSGSGTDFTLSINSVESEDIADYYCQQNNNWPTTFVQGTKLELK

SEQ ID NO: 13672 - protein, 107 aa, Artificial Sequence
  Description of Artificial Sequence: Synthetic polypeptide
  Variable LC G099K
DILLTQSPVILSVSPGERVSFSCRASQSIGTNIHWYQQRTNGSPRLLIKYASESISGIPSRFSGSGSGTDFTLSINSVESEDIADYYCQQNNNWPTTFKQGTKLELK

SEQ ID NO: 13673 - protein, 107 aa, Artificial Sequence
  Description of Artificial Sequence: Synthetic polypeptide
  Variable LC G099H
DILLTQSPVILSVSPGERVSFSCRASQSIGTNIHWYQQRTNGSPRLLIKYASESISGIPSRFSGSGSGTDFTLSINSVESEDIADYYCQQNNNWPTTFHQGTKLELK

SEQ ID NO: 13674 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGCGTKLELK

SEQ ID NO: 13675 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGDGTKLELK

SEQ ID NO: 13676 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGEGTKLELK

SEQ ID NO: 13677 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGFGTKLELK

SEQ ID NO: 13678 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGIGTKLELK

SEQ ID NO: 13679 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGMGTKLELK

SEQ ID NO: 13680 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGNGTKLELK

SEQ ID NO: 13681 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGPGTKLELK

SEQ ID NO: 13682 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGTGTKLELK

SEQ ID NO: 13683 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGVGTKLELK

SEQ ID NO: 13684 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGWGTKLELK

SEQ ID NO: 13685 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGYGTKLELK

SEQ ID NO: 13686 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGKGTKLELK

SEQ ID NO: 13687 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGHGTKLELK

SEQ ID NO: 13688 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGRGTKLELK

SEQ ID NO: 13689 - protein, 107 aa, Artificial Sequence
  Description of Artificial Sequence: Synthetic polypeptide
  Variable LC T5P
DILLPQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13690 - protein, 107 aa, Artificial Sequence
  Description of Artificial Sequence: Synthetic polypeptide
  Variable LC R24G
DILLTQSPVILSVSPGERVSFSCGASQSIGTNIHWYQQRTNGSPRLLIKYASESISGIPSRFSGSGSGTDFTLSINSVESEDIADYYCQQNNNWPTTFGAGTKLELK

SEQ ID NO: 13691 - protein, 119 aa, Homo sapiens
  MOD_RES (58)..(58): Asp or an amino acid having a side chain that is nonpolar and/or is charge neutral or positive and/or is not small
  MOD_RES (101)..(101): Tyr or an amino acid having a side chain that is nonpolar and/or a side chain that is non-neutral and/or a side chain that is not large
  MOD_RES (102)..(102): Tyr or an amino acid having a side chain that is nonpolar and/or a side chain that is non-neutral and/or a side chain that is not large
  MOD_RES (103)..(103): Asp or an amino acid having a side chain that is nonpolar and/or is charge neutral or positive and/or is not small
  MOD_RES (105)..(105): Glu or an amino acid having a side chain that is nonpolar and/or is charge neutral or positive and/or is not small
QVQLKQSGPGLVQPSQSLSITCTVSGFSLTNYGVHWVRQSPGKGLEWLGVIWSGGNTXYNTPFTSRLSINKDNSKSQVFFKMNSLQSNDTAIYYCARALTXXXYXFAYWGQGTLVTVSA

SEQ ID NO: 13692 - protein, 108 aa, Homo sapiens
SYELMQPPSVSVAPGMTARISCGANNIGSETVHWYQQKPGQAPVLVIYYDSDRPSGIPERFSGSKSGNTATLTITRVEAGDEADYYCQVWDSSTDHPVFGGGTKLTVL

SEQ ID NO: 13693 - protein, 107 aa, Homo sapiens
DIQLTQSPSSLSASVGDRVTITCQASQDISNYLNWYQQKPGKAPKLLIYDASNTETGVPSRFSGSGSGTDFTFTISSLQPEDIATYFCQHYANLPLTFGPGTKVDIK

SEQ ID NO: 13694 - protein, 110 aa, Homo sapiens
QSVLTQPPSVSAAPGQEVTISCSGSNSNIGNNYVSWYQQLPGTAPKLLIYDNNERPSGIPDRFSGSKSGTSATLGITGLQTGDEADYYCGTWDSSLSAGVFGGGTKLTVL

SEQ ID NO: 13695 - protein, 108 aa, Homo sapiens
SYELMQPPSVSVAPGQTAGITCGGRNIGSKSVHWYQQKPGQAPLLVIYYDDDRPSGIPERFSGSNSENTATLTISRVEAGDEADYFCQVWDSSSDHYVFGAGTKLTVL

SEQ ID NO: 13696 - protein, 110 aa, Homo sapiens
QPVLTQPASVSGSPGQSITISCTGTSSDIGAYHYISWYQQHPGKPPKLMIFDVAKRPSGVSDRFSGSKSGNTASLTISGLQADDEADYYCSSFSRDTDVIFGGGTKLTVL

SEQ ID NO: 13697 - protein, 110 aa, Homo sapiens
QSVLTQPPSASGTPGQRVTISCSGSSSNIGSNAVNWYQQLPGKAPKLLIYFDDLLPSGVSDRFSGSKSGTSASLAISGLQSEDEADYYCAAWDDSLNGWVFGGGTKLTVL

SEQ ID NO: 13698 - protein, 107 aa, Homo sapiens
NIQMTQSPPSLSAFVGDRVTITCQASQAINNYLNWYQQKPGKAPKLLIYDASNLETGVPSRFSGSGSGTDFTFTISSLQPEDNATYYCQQYDKLPLTFGGGTKVEIK

SEQ ID NO: 13699 - protein, 110 aa, Homo sapiens
QSVLTQPASVSGSPGQSITISCTGTTSDVGGFNYVSWYQQHPGKVPKLIIFDVSNRPSSVSDRFSGSKSVNTASLTISGLQAEDEADYYCSSYTDSGSYIFGTGTKVTVL

SEQ ID NO: 13700 - protein, 110 aa, Homo sapiens
QAVLTQPASVSGSPGQSITISCTGTSSDVGGYNYVSWYQQHPGKAPKLIIYDVTKRPSGFSNRFSGSKSGNTASLTISGLQAEDEADYYCSSYTTSSTRVFGTGTKVTVL

SEQ ID NO: 13701 - protein, 110 aa, Homo sapiens
SYELMQPASVSGSPGQSITISCTGTSSDIGDYNYVSWYQQHPGKAPKLIIYDVSIRPSGVSLRFSGSKSGNTASLTISGLQAEDEADYYCSSYRNTDTLEFGGGTKVTVL

SEQ ID NO: 13702 - protein, 110 aa, Homo sapiens
QSVLTQPPSASGTPGQRVTISCSGSTANIGRNYVNWYQQFPGTAPKLLMYSNDQSPSGVRGRFSGSKSGTSASLAINGLQSEDEADYYCAAWDDRLNAYVFGTGTKLTVL

SEQ ID NO: 13703 - protein, 107 aa, Homo sapiens
AIQLTQSPSTLSASVGDRVTITCRASQSISSWLAWYQQKPGKAPKLLIYAASSLQSGVPSRFSGSGSGTDFTLTISSLQPEDFATYYCQQSYSTPLTFGGGTKVEIK

SEQ ID NO: 13704 - protein, 107 aa, Homo sapiens
AIRMTQSPSSVSASVGDRVTITCRASQGIDSWLAWYQQKPGEAPKLLIYGASNLQSGVPIRFSGSGSGTDFTLTIRSLQPEDFATYFCQQSHGAPYTFGQGTKVEIK

SEQ ID NO: 13705 - protein, 110 aa, Homo sapiens
QSVVTQPPSVSAAPGQKVTISCSGSTSNIENYSVSWYQQLPGTAPKLLIYDNNKRPSGIPDRFSGSKSGTSATLGITGLQTGDEADYYCGTWDNRLSSVVFGGGTKVTVL

SEQ ID NO: 13706 - protein, 106 aa, Homo sapiens
DIVMTQSPVSLSASVGDSVTITCRASQSISSYLNWYQQKPGKAPKLLIYAASSLQSGVPSRFSGSGSGTDFTLTISSLQPEDFATYYCQQSYSLYTFGQGTKLEIK

SEQ ID NO: 13707 - protein, 110 aa, Homo sapiens
QSVLTQPPSASGSPGQSVTISCTGARSDVGGYNYVSWYQQHPGKAPKLMIYDVSNRPSGVSNRFSGSKSGNTASLTISGLQAEDEADYYCSSYTSSSTYVFGTGTKLTVL

SEQ ID NO: 13708 - protein, 107 aa, Homo sapiens
DVVMTQSPATLSLSPGERATLSCRASQSVNTYLAWYQQKPGQAPRLLIYDASSRATGIPARFSGSGSGTDFTLTISSLEPEDFATYYCQQTYSTPFTFGPGTKVDIK

SEQ ID NO: 13709 - protein, 113 aa, Homo sapiens
EIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYTTPLTFGGGTKVEIK

SEQ ID NO: 13710 - protein, 108 aa, Homo sapiens
QAVVTQPPSASVAPGQTARITCEGNNIESKSVHWYQQKPGQAPVLVIYYDRDRPSGIPERFSGSNSGNTATLTISRVEAGDEADYYCQVWDSSSDHPVFGGGTKLTVL

SEQ ID NO: 13711 - protein, 108 aa, Homo sapiens
QPVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKLTVR

SEQ ID NO: 13712 - protein, 109 aa, Homo sapiens
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHHVVFGGGTKLTVL

SEQ ID NO: 13713 - protein, 111 aa, Homo sapiens
QPVLTQPPSASGTPGQRVTISCSGSSSNIGSYTVNWYQQLPGTAPKLLIYNNNERPSGVPDRFSGSKSGTSASLAISGLQSEDEADYYCASWDDRLSGDVIFGGGTKLTVL

SEQ ID NO: 13714 - protein, 107 aa, Homo sapiens
DVVMTQSPATLSLSPGERATLSCRASQSVSSYLAWYQQKPGQAPRLLIYDASNRATGIPARFSGSGSGTDFTLTISSLEPEDFATYYCQQYQVYPTTFGQGTRLEIK

SEQ ID NO: 13715 - protein, 108 aa, Homo sapiens
LPVLTQPPSVSVAPGETAKITCGGTYIVRKIVHWYQQKPGQAPRLVIYYDAARPSGIPERFSGSNSGNTATLTISGVEAGDEADYYCQVWDNDSDHYVFGPGTKVTVL

SEQ ID NO: 13716 - protein, 110 aa, Homo sapiens
QAVLTQPASVSGSPGQSITISCTGTSSDVGDYNYVSWYQQHPGKAPKLMIYDVSNRPSGVSYRFSGSKSGNTASLTISGLQAEDEADYYCSSYTSSSSYVFGTGTKVTVL

SEQ ID NO: 13717 - protein, 108 aa, Homo sapiens
QSALTQPASVSVAPGTTARITCGGSNIARKNVHWYQQKPGQAPLVVVSDESDRPSGIPERFSGSNSGNTATLTISRVEAGDEADYYCQVWDSSSDHPVFGGGTKLTVL

SEQ ID NO: 13718 - protein, 110 aa, Homo sapiens
QPVLTQPPSASGTPGQRVTISCSGSSSNIGRNYVFWYQQLPGTAPKLLIYSNNQRPSGVPDRFSGSKSGTSASLAISGLQSEDEADYYCAAWDDSLNVVVFGGGTKLTVL

SEQ ID NO: 13719 - protein, 107 aa, Homo sapiens
DIQLTQSPSSLSASVGDRVTIACRASQSISSYLNWYQKKVGKAPKLLIYAASSLQSGVPSRFSGSGSGTDFTLTISSLQPEDFATYYCQQSYSIPVTFGQGTKVEIK

SEQ ID NO: 13720 - protein, 110 aa, Homo sapiens
QSVLTQPPSVSAAPGQEVTISCSGSNSNIGNNYVSWYQQLPGTAPKLLIYDNNERPSGIPDRFSGSKSGTSATLGITGLQTGDEADYYCSTWDSSLSAVVFGGGTKLTVL

SEQ ID NO: 13721 - protein, 110 aa, Homo sapiens
QSVLTQPPSVSAAPGQEVTISCSGSNSNIEPNYVSWYQQLPGTAPKLLIYSTAERPSGIPDRFSGSKSGTSATLGITGLQTGDEADYYCSTWDSSLSAVVFGGGTKLTVL

SEQ ID NO: 13722 - protein, 110 aa, Homo sapiens
QSVLTQPPSVSAAPGQEVTISCSGSNSNIENNYVSWYQQLPGTAPKLLIYSNNERPSGIPDRFSGSKSGTSATLGITGLQTGDEADYYCGTFDSSLSAVVFGGGTKLTVL

SEQ ID NO: 13723 - protein, 110 aa, Homo sapiens
QSVLTQPPSVSAAPGQEVTISCSGSNSNIGNNYVSWYQQLPGTAPKLLIYDTAERPSGIPDRFSGSKSGTSATLGITGLQTGDEADYYCSTWDSSLSAVLFGGGTKLTVL

SEQ ID NO: 13724 - protein, 110 aa, Homo sapiens
QSVLTQPPSVSAAPGQEVTISCSGSNSNIPNNYVSWYQQLPGTAPKLLIYSNYERPSGIPDRFSGSKSGTSATLGITGLQTGDEADYYCSTWDSSLSAVVFGGGTKLTVL

SEQ ID NO: 13725 - protein, 110 aa, Homo sapiens
QSVLTQPPSVSAAPGQEVTISCSGSNSNIGPNYVSWYQQLPGTAPKLLIYDNNERPSGIPDRFSGSKSGTSATLGITGLQTGDEADYYCSTFDSSLSAAVFGGGTKLTVL

SEQ ID NO: 13726 - protein, 110 aa, Homo sapiens
QSVLTQPPSVSAAPGQEVTISCSGSNSNIPNNYVSWYQQLPGTAPKLLIYSNSERPSGIPDRFSGSKSGTSATLGITGLQTGDEADYYCSTWDSSLSAALFGGGTKLTVL

SEQ ID NO: 13727 - protein, 110 aa, Homo sapiens
QSVLTQPPSVSEAPRQRVSISCSGSSSNIGNNAVNWYQQLPGKAPKLLIYFDDLLPLGVSDRFSGSKSGTSASLAISGLQSEDEADYYCAAWDDSLKGYVFGTGTKVTVL

SEQ ID NO: 13728 - protein, 110 aa, Homo sapiens
QSVLTQPPSVSEAPRQRVSISCSGSSSNIGDNAVNWYQQLPGKAPKLLIYYDDLHPSGVSDRFSGSKSGTSASLAISGLQSEDEADYYCAAWDDSLKGYVFGTGTKVTVL

SEQ ID NO: 13729 - protein, 110 aa, Homo sapiens
QSVLTQPPSVSAAPGQEVTISCSGSNSNIGNNYVSWYQQLPGTAPKLLIYSTNERPSGIPDRFSGSKSGTSATLGITGLQTGDEADYYCGTWDSSLSAGVFGGGTKLTVL

SEQ ID NO: 13730 - protein, 110 aa, Homo sapiens
QSVLTQPPSVSAAPGQEVTISCSGSNSNIENNYVSWYQQLPGTAPKLLIYDNRERPSGIPDRFSGSKSGTSATLGITGLQTGDEADYYCGTWDSSLSAGVFGGGTKLTVL

SEQ ID NO: 13731 - protein, 110 aa, Homo sapiens
QSVLTQPPSVSAAPGQEVTISCSGSNSNIEPNYVSWYQQLPGTAPKLLIYSTYERPSGIPDRFSGSKSGTSATLGITGLQTGDEADYYCGTFDSSLSAAVFGGGTKLTVL

SEQ ID NO: 13732 - protein, 110 aa, Homo sapiens
QSVLTQPPSVSAAPGQEVTISCSGSNSNIGNNYVSWYQQLPGTAPKLLIYSTNERPSGIPDRFSGSKSGTSATLGITGLQTGDEADYYCGTWDSSLSAALFGGGTKLTVL

SEQ ID NO: 13733 - protein, 110 aa, Homo sapiens
QSVLTQPPSVSAAPGQEVTISCSGSNSNIENNYVSWYQQLPGTAPKLLIYDNAERPSGIPDRFSGSKSGTSATLGITGLQTGDEADYYCSTWDSSLSAVVFGGGTKLTVL

SEQ ID NO: 13734 - protein, 110 aa, Homo sapiens
QSVLTQPPSVSAAPGQEVTISCSGSNSNIGNNYVSWYQQLPGTAPKLLIYDNAERPSGIPDRFSGSKSGTSATLGITGLQTGDEADYYCSTWDSSLSAVLFGGGTKLTVL

SEQ ID NO: 13735 - protein, 110 aa, Homo sapiens
QSVLTQPPSVSAAPGQEVTISCSGSNSNIGNNYVSWYQQLPGTAPKLLIYDNNERPSGIPDRFSGSKSGTSATLGITGLQTGDEADYYCGTFDSSLSAALFGGGTKLTVL

SEQ ID NO: 13736 - protein, 110 aa, Homo sapiens
QSVLTQPPSVSAAPGQEVTISCSGSNSNIPNNYVSWYQQLPGTAPKLLIYSTSERPSGIPDRFSGSKSGTSATLGITGLQTGDEADYYCSTWDSSLSAVVFGGGTKLTVL

SEQ ID NO: 13737 - protein, 110 aa, Homo sapiens
QSVLTQPPSVSAAPGQEVTISCSGSNSNIENNYVSWYQQLPGTAPKLLIYSNRERPSGIPDRFSGSKSGTSATLGITGLQTGDEADYYCSTFDSSLSAVVFGGGTKLTVL

SEQ ID NO: 13738 - protein, 110 aa, Homo sapiens
QSVLTQPPSVSAAPGQEVTISCSGSNSNITNNYVSWYQQLPGTAPKLLIYDNNERPSGIPDRFSGSKSGTSATLGITGLQTGDEADYYCSTWDSSLSALLFGGGTKLTVL

SEQ ID NO: 13739 - protein, 110 aa, Homo sapiens
QSVLTQPPSVSAAPGQEVTISCSGSNSNIPNNYVSWYQQLPGTAPKLLIYDNNERPSGIPDRFSGSKSGTSATLGITGLQTGDEADYYCSTWDSSLSAVLFGGGTKLTVL

SEQ ID NO: 13740 - protein, 110 aa, Homo sapiens
QSVLTQPPSVSAAPGQEVTISCSGSNSNIGPNYVSWYQQLPGTAPKLLIYDNRERPSGIPDRFSGSKSGTSATLGITGLQTGDEADYYCSTWDSSLSAGVFGGGTKLTVL

SEQ ID NO: 13741 - protein, 110 aa, Homo sapiens
QSVLTQPPSVSEAPRQRVSISCSGSSSNIGNNAVNWYQQLPGKAPKLLIYFDDLLPQGVSDRFSGSKSGTSASLAISGLQSEDEADYYCAAWDDSLKGYVFGTGTKVTVL

SEQ ID NO: 13742 - protein, 110 aa, Homo sapiens
QSVLTQPPSVSEAPRQRVSISCSGSSSNIGNNAVNWYQQLPGKAPKLLIYFDDLHPSGVSDRFSGSKSGTSASLAISGLQSEDEADYYCSAWDDSLKGYVFGTGTKVTVL

SEQ ID NO: 13743 - protein, 110 aa, Homo sapiens
QSVLTQPPSVSEAPRQRVSISCSGSSSNIGNNAVNWYQQLPGKAPKLLIYFDDLHPSGVSDRFSGSKSGTSASLAISGLQSEDEADYYCAAWDDSLKGYVFGTGTKVTVL

SEQ ID NO: 13744 - protein, 110 aa, Homo sapiens
QSVLTQPPSVSEAPRQRVSISCSGSSSNIGNNAVNWYQQLPGKAPKLLIYFDDLLPSGVSDRFSGSKSGTSASLAISGLQSEDEADYYCAAWDDSLKGYVFGTGTKVTVL

SEQ ID NO: 13745 - protein, 110 aa, Homo sapiens
QSVLTQPPSVSEAPRQRVSISCSGSSSNIGNNAVNWYQQLPGKAPKLLIYYDDLLPSGVSDRFSGSKSGTSASLAISGLQSEDEADYYCAAWDDSLKGYVFGTGTKVTVL

SEQ ID NO: 13746 - protein, 110 aa, Homo sapiens
QSVLTQPPSVSEAPRQRVSISCSGSSSNVGNNAVNWYQQLPGKAPKLLIYFDDLLPSGVSDRFSGSKSGTSASLAISGLQSEDEADYYCAAWDDSLKGYVFGTGTKVTVL

SEQ ID NO: 13747 - protein, 110 aa, Homo sapiens
QSVLTQPPSVSEAPRQRVSISCSGSSSNIGNNAVNWYQQLPGKAPKLLIYYDDLLPSGVSNRFSGSKSGTSASLAISGLQSEDEADYYCAAWDDSLKGYVFGTGTKVTVL

SEQ ID NO: 13748 - protein, 109 aa, Homo sapiens
QSVLTQPPSVSEAPRQRVSISCSGSSSNIGNNAVNWYQQLPGKAPKLLIYYDDLLPSGVSDRFSGSKSGTSASLAISGLQSEDEADYYCAAWDDSLKGYVFGTGTKVTV

SEQ ID NO: 13749 - protein, 107 aa, Artificial Sequence
  Description of Artificial Sequence: Synthetic polypeptide
  antibody variable region sequence
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 13750 - protein, 117 aa, Artificial Sequence
  Description of Artificial Sequence: Synthetic polypeptide
  antibody variable region sequence
EVQLVESGGGLVQPGGSLRLSCAASGFTFSSYWMSWVRQAPGKGLEWVANIKQDGSEENYVDSVKGRFTVSRDNAKNSLYLQMNSLRAEDTAVYYCARTYSGFEDYWGQGTLVTVSS

SEQ ID NO: 13751 - protein, 117 aa, Artificial Sequence
  Description of Artificial Sequence: Synthetic polypeptide
  antibody variable region sequence
EVQLVESGGGLVQPGGSLRLSCAASGFTFSDYWMSWVRQAPGRGLEWVAHINQDGSEKYYVDSVKGRFTLSRDTAKNSLYLQMNSLRAEDTAVYYCARGFLIYFDYWGQGTLVTVSS

SEQ ID NO: 13752 - protein, 107 aa, Artificial Sequence [sequence omitted]

SEQ ID NO: 13753 - protein, 107 aa, Artificial Sequence
  Description of Artificial Sequence: Synthetic polypeptide
  Cetuximab A100 LELK104-107 light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 13754 - protein, 107 aa, Artificial Sequence
  Description of Artificial Sequence: Synthetic polypeptide
  Cetuximab Q100 VEIK104-107 light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKVEIK

SEQ ID NO: 13755 - protein, 107 aa, Artificial Sequence
  Description of Artificial Sequence: Synthetic polypeptide
  Cetuximab Q100 LELK104-107 light chain variable domain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGQGTKLELK

SEQ ID NO: 13756 - protein, 107 aa, Artificial Sequence
  Description of Artificial Sequence: Synthetic polypeptide
  Humanized Cetuximab (H225) light chain variable domain
EIVLTQSPATLSLSPGERATLSCRASQSIGTNIHWYQQRPGQAPRLLIKYASESISGIPARFSGSGSGTDFTLTISSLEPEDFAVYYCQQNNNWPTTFGGGTKVEIK

SEQ ID NO: 13757 - protein, 107 aa, Artificial Sequence
  Description of Artificial Sequence: Synthetic polypeptide
  LC-I29S light chain variable domain amino acid Q100 VEIK104-107
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGQGTKVEIK

SEQ ID NO: 13758 - protein, 107 aa, Artificial Sequence; identical to SEQ ID NO: 13281
  Description of Artificial Sequence: Synthetic polypeptide
  LC-I29S light chain variable domain amino acid A100 LELK104-107

SEQ ID NO: 13759 - protein, 107 aa, Artificial Sequence
  Description of Artificial Sequence: Synthetic polypeptide
  LC-I29S light chain variable domain amino acid Q100 LELK104-107
DILLTQSPVILSVSPGERVSFSCRASQSSGTNIHWYQQRTNGSPRLLIKYASESISGIPSRFSGSGSGTDFTLSINSVESEDIADYYCQQNNNWPTTFGEGTKLELK

SEQ ID NO: 13760 - protein, 107 aa, Artificial Sequence
  Description of Artificial Sequence: Synthetic polypeptide
  EP-h1, 3 light chain variable domain amino acid Q100 VEIK
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGQGTKVEIK

SEQ ID NO: 13761 - protein, 107 aa, Artificial Sequence
  Description of Artificial Sequence: Synthetic polypeptide
  EP-h1, 3 light chain variable domain amino acid A100 LELK
AIQLTQSPSSLSASVGDRVTITCRASQSIGTNIHWYQQKPGQAPRLLIYYASESISGVPSRFSGSGSGTDFTLTISSLQPEDFATYYCQQNNNWPTTFGAGTKLELK

SEQ ID NO: 13762 - protein, 107 aa, Artificial Sequence
  Description of Artificial Sequence: Synthetic polypeptide
  EP-h2 light chain variable domain amino acid Q100 VEIK
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGQGTKVEIK

SEQ ID NO: 13763 - protein, 107 aa, Artificial Sequence
  Description of Artificial Sequence: Synthetic polypeptide
  EP-h2 light chain variable domain amino acid A100 LELK
AIQLTQSPSSLSASVGDRVTITCRASQSIGTNIHWYLQKPGQSPQLLIYYASESISGVPSRFSGSGSGTDFTLTISSLQPEDFATYYCQQNNNWPTTFGAGTKLELK

SEQ ID NO: 13764 - protein, 107 aa, Artificial Sequence
  Description of Artificial Sequence: Synthetic polypeptide
  EP-h4 light chain variable domain amino acid Q100 VEIK
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGQGTKVEIK

SEQ ID NO: 13765 - protein, 107 aa, Artificial Sequence
  Description of Artificial Sequence: Synthetic polypeptide
  EP-h4 light chain variable domain amino acid A100 LELK
AIQLTQSPSSLSASVGDRVTITCRASQSIGTNIHWYQQKPGKAPKLLIYYASESISGVPSRFSGSGSGTDFTLTISSLQPEDFATYYCQQNNNWPTTFGAGTKLELK

SEQ ID NO: 13766 - protein, 107 aa, Artificial Sequence
  Description of Artificial Sequence: Synthetic polypeptide
  EP-h5 light chain variable domain amino acid Q100 VEIK
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIK

SEQ ID NO: 13767 - protein, 107 aa, Artificial Sequence
  Description of Artificial Sequence: Synthetic polypeptide
  EP-h5 light chain variable domain amino acid A100 LELK
DIQMTQSPSSLSASVGDRVTITCRASQSIGTNIHWYQQKPGQAPRLLIYYASESISGIPDRFSGSGSGTDFTLTISRLEPEDFAVYYCQQNNNWPTTFGAGTKLELK

SEQ ID NO: 13768 - protein, 107 aa, Artificial Sequence
  Description of Artificial Sequence: Synthetic polypeptide
  EP-h8 light chain variable domain amino acid Q100 VEIK
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGQGTKVEIK

SEQ ID NO: 13769 - protein, 107 aa, Artificial Sequence
  Description of Artificial Sequence: Synthetic polypeptide
  EP-h8 light chain variable domain amino acid A100 LELK
AIQLTQSPSSLSASVGDRVTITCRASQSIGTNIHWYQQKPGQAPRLLIYYASESISGIPARFSGSGSGTEFTLTISSLQSEDFAVYYCQQNNNWPTTFGAGTKLELK

SEQ ID NO: 13770 - protein, 107 aa, Artificial Sequence
  Description of Artificial Sequence: Synthetic polypeptide
  EP-h13, 14 light chain variable domain amino acid Q100 VEIK
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGQGTKVEIK

SEQ ID NO: 13771 - protein, 107 aa, Artificial Sequence
  Description of Artificial Sequence: Synthetic polypeptide
EIVLTQSPATLSLSPGERATLSCRASQSIGTNIHWYQQKPGQAPRLLIYYASESISGVPSRFSGSGSGTEFTLTISSLQPDDFATYYCQQNNNWPTTFGAGTKLELK

SEQ ID NO: 13772 - protein, 214 aa, Artificial Sequence
  Description of Artificial Sequence: Synthetic polypeptide
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13773 - protein, 107 aa, Artificial Sequence
  Description of Artificial Sequence: Synthetic polypeptide
AIQLTQSPSSLSASVGDRVTITCRASQSIGTNIHWYLQKPGQSPQLLIYYASESISGIPDRFSGSGSGTDFTLTISRLEPEDFAVYYCQQNNNWPTTFGQGTKVEIK

SEQ ID NO: 13774 - protein, 214 aa, Artificial Sequence
  Description of Artificial Sequence: Synthetic polypeptide
EIVLTQSPATLSLSPGERATLSCRASQSIGTNIHWYQQKPGKAPKLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13775 - protein, 214 aa, Artificial Sequence
  Description of Artificial Sequence: Synthetic polypeptide
  FEP-h5 light chain variable domain amino acid A100 LELK
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13776 - protein, 107 aa, Artificial Sequence
  Description of Artificial Sequence: Synthetic polypeptide
  FEP-h5 light chain variable domain amino acid Q100 LELK
EIVLTQSPATLSLSPGERATLSCRASQSIGTNIHWYQQKPGQAPRLLIYYASESISGVPSRFSGSGSGTDFTLTISSLQPEDFATYYCQQNNNWPTTFGQGTKVEIK

SEQ ID NO: 13777 - protein, 214 aa, Artificial Sequence
  Description of Artificial Sequence: Synthetic polypeptide
  FEP-h6, 7, 8 light chain variable domain amino acid A100 LELK
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13778 - protein, 107 aa, Artificial Sequence
  Description of Artificial Sequence: Synthetic polypeptide
  FEP-h6, 7, 8 light chain variable domain amino acid Q100 LELK
AIQLTQSPSSLSASVGDRVTITCRASQSIGTNIHWYQQKPGQAPRLLIYYASESISGIPPRFSGSGSGTDFTLTISRLEPEDFAVYYCQQNNNWPTTFGQGTKVEIK

SEQ ID NO: 13779 - protein, 214 aa, Artificial Sequence
  Description of Artificial Sequence: Synthetic polypeptide
  FEP-h9, 10, 11, 12, 20  light chain variable domain amino acid A100 LELK
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13780 - protein, 107 aa, Artificial Sequence
  Description of Artificial Sequence: Synthetic polypeptide
  FEP-h9, 10, 11, 12, 20  light chain variable domain amino acid Q100 LELK
AIQLTQSPSSLSASVGDRVTITCRASQSIGTNIHWYQQKPGQAPRLLIYYASESISGIPDRFSGSGSGTDFTLTISRLEPEDFAVYYCQQNNNWPTTFGQGTKVEIK

SEQ ID NO: 13781 - protein, 214 aa, Artificial Sequence
  Description of Artificial Sequence: Synthetic polypeptide
  FEP-h13, 14, 15, 16, 21 light chain variable domain amino acid A100 LELK
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13782 - protein, 107 aa, Artificial Sequence
  Description of Artificial Sequence: Synthetic polypeptide
  FEP-h13, 14, 15, 16, 21 light chain variable domain amino acid Q100 LELK
EIVLTQSPATLSLSPGERATLSCRASQSIGTNIHWYQQKPGQAPRLLIYYASESISGIPARFSGSGSGTEFTLTISSLQSEDFAVYYCQQNNNWPTTFGQGTKVEIK

SEQ ID NO: 13783 - protein, 108 aa, Mus sp.
  MOD_RES (26)..(26): Any amino acid
  MOD_RES (32)..(33): Any amino acid
  MOD_RES (51)..(51): Any amino acid
  MOD_RES (88)..(89): Any amino acid
  MOD_RES (92)..(92): Any amino acid
  MOD_RES (95)..(95): Any amino acid
SYELTQPPSVSVAPGQTARITCSGDXLGDKYXXWYQQKPGQAPVLVIYEDXKRPSGIPERFSGSNSGNTATLTISGTQAEDEADYYCXXWDXDWXMPVFGGGTKLTVL

SEQ ID NO: 13784 - protein, 107 aa, Artificial Sequence
  Description of Artificial Sequence: Synthetic polypeptide
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIK

SEQ ID NO: 13785 - protein, 107 aa, Artificial Sequence
  Description of Artificial Sequence: Synthetic polypeptide
DIQMTQSPSSMSVSVGDRVTITCHSSQDINSNIGWLQQKPGKSFKGLIYHGTNLDDGVPSRFSGSGSGTDYTLTISSLQPEDFATYYCVQYEQFPWTFGGGTKLEIK

SEQ ID NO: 13786 - protein, 107 aa, Artificial Sequence
  Description of Artificial Sequence: Synthetic polypeptide
DIQMTQSPSSMSVSVGDRVTITCHSSQDINSNLGWLQQKPGKSFKGLIYHGANLHDGVPSRFSGSGSGTDYTLTISSLQPEDFATYYCVQYAEFPWTFGGGTKLEIK

SEQ ID NO: 13787 - protein, 107 aa, Artificial Sequence
  Description of Artificial Sequence: Synthetic polypeptide
DIQMTQSPSSMSVSVGDRVTITCHSSQDINSNLGWLQQKPGKSFKGLIYHGSNLDHGVPSRFSGSGSGTDYTLTISSLQPEDFATYYCVQYDQFPWTFGGGTKLEIK

SEQ ID NO: 13788 - protein, 107 aa, Artificial Sequence
  Description of Artificial Sequence: Synthetic polypeptide
DIQMTQSPSSMSVSVGDRVTITCHSSQDITYNIGWLQQKPGKSFKGLIYHGANLDDGVPSRFSGSGSGTDYTLTISSLQPEDFATYYCVQYDEFPWTFGGGTKLEIK

SEQ ID NO: 13789 - protein, 107 aa, Artificial Sequence
  Description of Artificial Sequence: Synthetic polypeptide
DIQMTQSPSSMSVSVGDRVTITCHSSQDITYNVGWLQQKPGKSFKGLIYHGSNLDHGVPSRFSGSGSGTDYTLTISSLQPEDFATYYCVQYDDFPWTFGGGTKLEIK

SEQ ID NO: 13790 - protein, 107 aa, Artificial Sequence
  Description of Artificial Sequence: Synthetic polypeptide
DIQMTQSPSSMSVSVGDRVTITCHSSQDINMNVGWLQQKPGKSFKGLIYHGAILDDGVPSRFSGSGSGTDYTLTISSLQPEDFATYYCVQYAEFPWTFGGGTKLEIK

SEQ ID NO: 13791 - protein, 112 aa, Homo sapiens
EIHMTQTTSSLSASLGDRVTISCSASQDIRNYLNWYQQKPDGTVKLLIYYTSTLHSGVPSRFSGSGSGTDYSLTISNLEPEDIATYYCQQYSKIPYTFTGGTKLEIKRADAA

SEQ ID NO: 13792 - protein, 107 aa, Mus musculus
DIQMTQTTSSLSASLGDRVTISCRSSQDIRNYLNWYQQKPDGTVKLLIYYTSRSHSGVPSRFSGSGSGTDYSLTISNLEQEDIATYFCQQGNMFPFTFGGGTKLEIK

SEQ ID NO: 13793 - protein, 108 aa, Artificial Sequence; identical to SEQ ID NO: 8770
  Description of Artificial Sequence: Synthetic polypeptide

SEQ ID NO: 13794 - protein, 108 aa, Artificial Sequence; identical to SEQ ID NO: 8769
  Description of Artificial Sequence: Synthetic polypeptide

SEQ ID NO: 13795 - protein, 107 aa, Artificial Sequence
  Description of Artificial Sequence: Synthetic polypeptide
  synthetic construct
EIVLTQSPDFQSVTPKEKVTITCRASYSIGTNIHWYQQKPDQSPKLLIKYASESISGVPSRFSGSGSGTDFTLTINSLEAEDAATYYCQQNNEWPTSFGGGTKVEIK

SEQ ID NO: 13796 - protein, 107 aa, Artificial Sequence
  Description of Artificial Sequence: Synthetic polypeptide
  synthetic construct
EIVLTQSPDFQSVTPKEKVTITCRASYSIGTNIHWYQQKPDQSPKLLIKYASESISGVPSRFSGSGSGTDFTLTINSLEAEDAATYYCQQNNNWPTSFGGGTKVEIK

SEQ ID NO: 13797 - protein, 107 aa, Artificial Sequence
  Description of Artificial Sequence: Synthetic polypeptide
  synthetic construct
EIVLTQSPDFQSVTPKEKVTITCRASYSIGTNIHWYQQKPDQSPKLLIKYASESISGVPSRFSGSGSGTDFTLTINSLEAEDAATYYCQQNNNWPTTFGGGTKVEIK

SEQ ID NO: 13798 - protein, 107 aa, Artificial Sequence
  Description of Artificial Sequence: Synthetic polypeptide
  synthetic construct
EIVLTQSPDFQSVTPKEKVTITCRASYSIGTNIHWYQQKPDQSPKLLIKYASESISGVPSRFSGSGSGTDFTLTINSLEAEDAATYYCQQNNDWPTTFGGGTKVEIK

SEQ ID NO: 13799 - protein, 107 aa, Artificial Sequence
  Description of Artificial Sequence: Synthetic polypeptide
  synthetic construct
EIVLTQSPDFQSVTPKEKVTITCRASYSIGTNIHWYQQKPDQSPKLLIKYASESISGVPSRFSGSGSGTDFTLTINSLEAEDAATYYCQQNNDWPTSFGGGTKVEIK

SEQ ID NO: 13800 - protein, 109 aa, Artificial Sequence
  Description of Artificial Sequence: Synthetic polypeptide
  Rat-human chimeric polypeptide
DIQMTQSPSSLSASVGDRVTITCRASQGINNYLNWYQQKPGKAPKRLIYNTNNLQTGVPSRFSGSGSGTEYTLTISSLQPEDFATYYCLQHNSFPTFGQGTKLEIKRTV

SEQ ID NO: 13801 - protein, 109 aa, Artificial Sequence
  Description of Artificial Sequence: Synthetic polypeptide
  Rat-human chimeric polypeptide
DIQMTQSPSSLSASVGDRVTITCKASQNINNYLNWYQQKPGKAPKRLIYNTNNLQTGVPSRFSGSGSGTEYTLTISSLQPEDFATYYCLQHNSFPTFGQGTKLEIKRTV

SEQ ID NO: 13802 - protein, 120 aa, Artificial Sequence
  Description of Artificial Sequence: Synthetic polypeptide
  Chimeric rat-human sequence (I-HHD-11)
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDVWGQGTTVTVSS

SEQ ID NO: 13803 - protein, 108 aa, Artificial Sequence
  Description of Artificial Sequence: Synthetic polypeptide
  Chimeric rat-human sequence (I-KC1)
DIQMTQSPSSLSASVGDRVTITCRASQGIRNYLNWYQQKPGKAPKRLIYNTNNLQTGVPSRFSGSGSGTEFTLTISSLQPEDFATYYCLQHNSFPTFGQGTKLEIKRT

SEQ ID NO: 13804 - protein, 108 aa, Artificial Sequence
  Description of Artificial Sequence: Synthetic polypeptide
  Chimeric rat-human sequence (I-KC2)
DIQMTQSPSSLSASVGDRVTITCRASQGINNWLNWYQQKPGKAPKRLIYNTNNLQTGVPSRFSGSGSGTEFTLTISSLQPEDFATYYCLQHNSFPTFGQGTKLEIKRT

SEQ ID NO: 13805 - protein, 108 aa, Artificial Sequence
  Description of Artificial Sequence: Synthetic polypeptide
  Chimeric rat-human sequence (I-KC4)
DIQMTQSPSSLSASVGDRVTITCRASQGINNYLNWYQQKPGKAPKRLIYTTNNLQTGVPSRFSGSGSGTEFTLTISSLQPEDFATYYCLQHNSFPTFGQGTKLEIKRT

SEQ ID NO: 13806 - protein, 108 aa, Artificial Sequence
  Description of Artificial Sequence: Synthetic polypeptide
  Chimeric rat-human sequence (I-KC5)
DIQMTQSPSSLSASVGDRVTITCRASQGINNYLNWYQQKPGKAPKRLIYNANNLQTGVPSRFSGSGSGTEFTLTISSLQPEDFATYYCLQHNSFPTFGQGTKLEIKRT

SEQ ID NO: 13807 - protein, 108 aa, Artificial Sequence
  Description of Artificial Sequence: Synthetic polypeptide
  Chimeric rat-human sequence (I-KC6)
DIQMTQSPSSLSASVGDRVTITCRASQGINNYLNWYQQKPGKAPKRLIYNTSNLQTGVPSRFSGSGSGTEFTLTISSLQPEDFATYYCLQHNSFPTFGQGTKLEIKRT

SEQ ID NO: 13808 - protein, 108 aa, Artificial Sequence
  Description of Artificial Sequence: Synthetic polypeptide
  Chimeric rat-human sequence (I-KC7)
DIQMTQSPSSLSASVGDRVTITCRASQGINNYLNWYQQKPGKAPKRLIYNTNSLQTGVPSRFSGSGSGTEFTLTISSLQPEDFATYYCLQHNSFPTFGQGTKLEIKRT

SEQ ID NO: 13809 - protein, 108 aa, Artificial Sequence
  Description of Artificial Sequence: Synthetic polypeptide
  Chimeric rat-human sequence (I-KC8)
DIQMTQSPSSLSASVGDRVTITCRASQGINNYLNWYQQKPGKAPKRLIYNTNNLQSGVPSRFSGSGSGTEFTLTISSLQPEDFATYYCLQHNSFPTFGQGTKLEIKRT

SEQ ID NO: 13810 - protein, 108 aa, Artificial Sequence
  Description of Artificial Sequence: Synthetic polypeptide
  Chimeric rat-human sequence (I-KC9)
DIQMTQSPSSLSASVGDRVTITCRASQGINNYLNWYQQKPGKAPKRLIYNTNNLQTGVPSRFSGSGSGTEFTLTISSLQPEDFATYYCLQHNSYPTFGQGTKLEIKRT

SEQ ID NO: 13811 - protein, 216 aa, Homo sapiens
LADIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13812 - protein, 221 aa, Homo sapiens
LADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13813 - protein, 220 aa, Homo sapiens
LADIVLTQSPASLAVSLGQRATISCRASKSVSTSGYSFMHWYQLKPGQPPKLLIYLASNLESGVPARFSGSGSGTDFTLNIHPVEEEDAATYYCQHSREFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13814 - protein, 219 aa, Homo sapiens
DIVMTQAAFSNPVTLGTSASISCRSSKSLLHSNGITYLYWYLQKPGQSPQLLIYQMSNLASGVPDRFSSSGSRTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13815 - protein, 220 aa, Homo sapiens
LADVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13816 - protein, 216 aa, Homo sapiens
LADIVMTQSHKFMSTSVGDRVSITCKASQDVTNAVAWYQQKPGQSPKLLIYWASIRHTGVPDRFTGSRSGTDYTLTINSVQAEDLALYYCQQHYNTPLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13817 - protein, 220 aa, Homo sapiens
LADVVMTQTPLSLPVSLGDQASISCRSSQSLVHSNGNTYLHWYLQKPGQSPKLLLYKVSNRFSGVPDRFSGSGSGTDFTLKISRVESEDLGVYFCSQNTHVYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13818 - protein, 215 aa, Homo sapiens
LAQIVLTQSPAIMSASPGEKVTMTCSASSSVSYIYWYQQKPGSSPRLLIYDASNLASGVPVRFSGSGSGTSYSLTISRMEAEDAATYYCQQWSSYPITFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13819 - protein, 216 aa, Homo sapiens
LADIQMTQTTSSLSASLGDRVTISCSASQGITNYLNWYQQKPDGTVKLLIYYSSSLHSGVPSRFSGSGSGTDYSLTISNLEPEDIATYYCQQYSEIPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13820 - protein, 215 aa, Homo sapiens
LAQIVLTQSPAIMSASPGEKVTITCSASSSVSYMHWFQQKPGTSPKLWIYSTSNLASGVPARFSGSGSGTSYSLTISRMEAEDAATYYCQQRSSYPYTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13821 - protein, 220 aa, Homo sapiens
LADIVLTQSPASLAVSLGQRATISCRASQSVSTSTYSYMHWYQQKSGQPPKLLIKYASNLESGVPARFSGSGSGTDFTLNIHPVEEEDTATYYCQHSWEIPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13822 - protein, 216 aa, Homo sapiens
LADIQMTQTTSSLSASLGDRVTISCRASQDISNYLNWYQQKPDGTVKVLIYYTSRLHSGVPSRFSGSGSGTDYSLTISNLEQEDIATYFCQQGNTLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13823 - protein, 216 aa, Homo sapiens
LADIQMTQTTSSLSASLGDRVTISCSASQDISNYLNWYQQKPDGTVKLLIYHTSTLHSGVPSRFSGSGSGTDYSLTISNLEPEDIATYYCQQYSKLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13824 - protein, 216 aa, Homo sapiens
LADIQMTQTTSSLSASLGDRVTISCSASQGISNYLNWYQQKPDGTVKLLIYYTSSLHSGVPSRFSGSGSGTDYSLTISNLEPEDIATYYCQQYSKLPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13825 - protein, 217 aa, Homo sapiens
LAENVLTQSPAIMSASPGEKVTMTCRASSSVSSSYLHWYQQKSGASPKLWIYSTSNLASGVPARFSGSGSGTSYSLTVNSVETEDAATYYCHQYSGFPFTFGSGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13826 - protein, 107 aa, Homo sapiens [sequence omitted]

SEQ ID NO: 13827 - protein, 113 aa, Artificial Sequence
  Description of Artificial Sequence: Synthetic polypeptide
  Synthetic construct of light chain variable region
DIVMTQTPLSLPVTPGEPASISCRSNQDLTHSNGNTYLEWYLQKPGQSPRLLIYKVSNRFSGVPDRFSGSGAGTDFTLRISRVEAEDVGVYYCMQGTHWPWTFGQGTKVDIKR

SEQ ID NO: 13828 - protein, 113 aa, Artificial Sequence
  Description of Artificial Sequence: Synthetic polypeptide
  Synthetic construct of light chain variable region
DIVMTQTPLSLPVTPGEPASISCRSSQSVDMGIGNNYLEWYLQKPGQSPRLLIYKVSNRFSGVPDRFSGSGAGTDFTLRISRVEAEDVGVYYCMQGTHWPWTFGQGTKVDIKR

SEQ ID NO: 13829 - protein, 108 aa, Artificial Sequence
  Description of Artificial Sequence: Synthetic polypeptide
  hVL
  MOD_RES (11)..(11): Any amino acid
  MOD_RES (21)..(21): Any amino acid
  MOD_RES (45)..(45): Any amino acid
  MOD_RES (83)..(83): Any amino acid
  MOD_RES (85)..(85): Any amino acid
  MOD_RES (100)..(100): Any amino acid
EIVLTQSPDFXSVTPKEKVTXTCRASQSIGTNIHWYQQKPDQSPXLLIKYASESISGVPSRFSGSGSGTDFTLTINSLEAEDXAXYYCQQNNNWPTTFGXGTKLEIKR

SEQ ID NO: 13830 - protein, 108 aa, Artificial Sequence
  Description of Artificial Sequence: Synthetic polypeptide
  hVL1
EIVLTQSPDFQSVTPKEKVTITCRASQSIGTNIHWYQQKPDQSPKLLIKYASESISGVPSRFSGSGSGTDFTLTINSLEAEDAATYYCQQNNNWPTTFGQGTKLEIKR

SEQ ID NO: 13831 - protein, 108 aa, Artificial Sequence
  Description of Artificial Sequence: Synthetic polypeptide
  hVL2
EIVLTQSPDFQSVTPKEKVTITCRASQSIGTNIHWYQQKPDQSPKLLIKYASESISGVPSRFSGSGSGTDFTLTINSLEAEDAADYYCQQNNNWPTTFGQGTKLEIKR

SEQ ID NO: 13832 - protein, 107 aa, Artificial Sequence
  Description of Artificial Sequence: Synthetic polypeptide
  hVL4
EIVLTQSPDFQSVTPKEKVTITCRASQSIGTNIHWYQQKPDQSPKLLIKYASESISGVPSRFSGSGSGTDFTLTINSLEAEDAADYYCQQNNNWPTTFGAGTKLEIK

SEQ ID NO: 13833 - protein, 95 aa, Homo sapiens
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLP

SEQ ID NO: 13834 - protein, 108 aa, Artificial Sequence
  Description of Artificial Sequence: Synthetic polypeptide
  muEGFR-7 VL and muEGFR13LC
DIQMTQSPSSLSASLGGKVTITCKASQDINNYLAWYQHKPGKGPRLLIHYTSTLHPGIPSRFSGSGSGRDYSFSISNLEPEDIATYYCLQYDNLLYTFGGGTKLEIKR

SEQ ID NO: 13835 - protein, 108 aa, Artificial Sequence
  Description of Artificial Sequence: Synthetic polypeptide
  muEGFR-12 VL
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 13836 - protein, 108 aa, Artificial Sequence
  Description of Artificial Sequence: Synthetic polypeptide
  huEGFR-7 VL v1.0
DIQMTQSPSSLSASVGDRVTITCRASQDINNYLAWYQHKPGKGPKLLIHYTSTLHPGIPSRFSGSGSGRDYSFSISSLEPEDIATYYCLQYDNLLYTFGQGTKLEIKR

SEQ ID NO: 13837 - protein, 108 aa, Artificial Sequence
  Description of Artificial Sequence: Synthetic polypeptide
  huEGFR-7 VL v1.01
DIQMTQSPSSLSASVGDRVTITCKASQDINNYLAWYQHKPGKGPKLLIHYTSTLHPGIPSRFSGSGSGRDYSFSISSLEPEDIATYYCLQYDNLLYTFGQGTKLEIKR

SEQ ID NO: 13838 - protein, 108 aa, Artificial Sequence
  Description of Artificial Sequence: Synthetic polypeptide
  huEGFR-7 VL_CDR grafted
DIQMTQSPSSLSASVGDRVTITCRASQDINNYLAWYQQKPGKAPKLLIYYTSTLHPGVPSRFSGSGSGTDFTFTISSLQPEDIATYYCLQYDNLLYTFGQGTKVEIKR

SEQ ID NO: 13839 - protein, 108 aa, Artificial Sequence
  Description of Artificial Sequence: Synthetic polypeptide
  huEGFR-12 VL v1.0
DVQITQSPSSLAASVGERITINCRASQSISRYLAWYQEKPGKTNKLLIYSGSTLQSGIPSRFSGSGSGTDFTLTISSLEPEDFAMYYCQQHNEYPWTFGQGTKLEIKR

SEQ ID NO: 13840 - protein, 108 aa, Artificial Sequence
  Description of Artificial Sequence: Synthetic polypeptide
  huEGFR-12 VL v1.01
DVQITQSPSSLAASVGERITINCRASKSISKYLAWYQEKPGKTNKLLIYSGSTLQSGIPSRFSGSGSGTDFTLTISSLEPEDFAMYYCQQHNEYPWTFGQGTKLEIKR

SEQ ID NO: 13841 - protein, 114 aa, Artificial Sequence
  Description of Artificial Sequence: Synthetic polypeptide
DIVMTQSPDSLAVSLGERATINCKSSQSVLYSSNNKNYLAWYQHKPGQPPNLLIYWASTRESGVPDRFSGSGSGTDFTLTISSLQAEDVAVYYCHQYYSTPFTFGPGTKVDIKR

SEQ ID NO: 13842 - protein, 108 aa, Artificial Sequence
  Description of Artificial Sequence: Synthetic polypeptide
DIQMTQSPSSVSASVGDRVTITCRASQGISSWLAWYQQQPGKAPKLLIYAASSLQSGVPSRFSGSGSGTDFTLTISSLQPEDFATYYCQQTNSFPLTFGGGTKVEIKR

SEQ ID NO: 13843 - protein, 107 aa, Artificial Sequence
  Description of Artificial Sequence: Synthetic polypeptide
DIQLTQSPSFLSASVGDRVTITCWASQGINNYLAWYQQKPGKAPKLLIYAASTLQTGVPSRFSGSGSGTEFTLTISSLQPEDFATYYCQQLNSYPLTFGGGTKVEIK

SEQ ID NO: 13844 - protein, 107 aa, Artificial Sequence
  Description of Artificial Sequence: Synthetic polypeptide
DIQMTQSPSTLSASVGDRVTITCRASQSTSSWLAWYQQKPGKAPTLLIYKASSLESGVPSKFSGSGSGTEFTLTISSLQPDDFATYYCQQYNRYSRTFGQGTKVEIK

SEQ ID NO: 13845 - protein, 108 aa, Artificial Sequence
  Description of Artificial Sequence: Synthetic polypeptide
EIALTQSPGTLSLSPGERATLSCRASQSVSSTYLAWYQQKPGQAPRLLIYGASSRATGIPDRFSGSGSGTDFTLTISRLEPEDFAVYYCQQYDSSPITFGQGTRLEIK

SEQ ID NO: 13846 - protein, 113 aa, Artificial Sequence
  Description of Artificial Sequence: Synthetic polypeptide
DVVMTQSPLSLPVALGQPASISCRSSQSLVYTDGNTYLNWFHQRPGQSPRRLIYKVSNRDSGVPDRFTGSGSGTDFTLKISRVEAEDVGVFYCMQGSHWPPYTFGQGTKLEIK

SEQ ID NO: 13847 - protein, 107 aa, Artificial Sequence
  Description of Artificial Sequence: Synthetic polypeptide
AIQLTQSPSSLSASVGDRVTITCRASQGIGNDLGWYQLRPGKAPKLLIYATSSLQSGVPSRFSGSGSGTDFTLTISSLQPEDFATYYCLQDYNYPWTFGQGTKVEIK

SEQ ID NO: 13848 - protein, 107 aa, Artificial Sequence
  Description of Artificial Sequence: Synthetic polypeptide
AIQMTQSPSSLSASVGDRVTITCRASQGIGYDLGWYQQKPGKAPKLLIYAASSLQSGVPSRFSGSGSGTDFTLTISSLQPEDFATYYCLQDYNYPWTFGQGTKVDIK

SEQ ID NO: 13849 - protein, 107 aa, Artificial Sequence
  Description of Artificial Sequence: Synthetic polypeptide
AIQMTQSPSSLSASVGDRVTITCRASQGIGNDLGWYQQKPGKAPNLLIYATSSLQSGVPSRFSGSGSGTDFTLTISSLQPEDFATYYCLQDYNYPWTFGQGTKVEIK

SEQ ID NO: 13850 - protein, 111 aa, Artificial Sequence
  Description of Artificial Sequence: Synthetic polypeptide
  synthetic antibody VL sequence
ESVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVLG

SEQ ID NO: 13851 - protein, 127 aa, Artificial Sequence
  Description of Artificial Sequence: Synthetic polypeptide
MGTPAQLLFLLLLWLPDTTGDIQMTQSPSTLSASVGDRVTITCRASQSISSWWAWYQQKPGKAPKLLIYDASSLESGVPSRFSGSGSGTEFTLTISSLQPDDFATYYCQQYHAHPTTFGGGTKVEIK

SEQ ID NO: 13852 - protein, 133 aa, Artificial Sequence
  Description of Artificial Sequence: Synthetic polypeptide
MGTPAQLLFLLLLWLPDTTGDIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYGSPITFGGGTKVEIK

SEQ ID NO: 13853 - protein, 128 aa, Artificial Sequence
  Description of Artificial Sequence: Synthetic polypeptide
MGTPAQLLFLLLLWLPDTTGEIVMTQSPATLSVSPGERATLSCRASQSVSSNLAWYQQKPGQAPRLLIYGASTRATGIPARFSGSGSGTEFTLTISSLQSEDFAVYYCQDYRTWPRRVFGGGTKVEIK

SEQ ID NO: 13854 - protein, 108 aa, Artificial Sequence
  Description of Artificial Sequence: Synthetic polypeptide
DILLTQSPGTLSLSPGERATLSCRASQSIGTNIHWYQQKPGQAPRLLIKYASESISGIPDRFSGSGSGTDFTLTISRLEPEDFAVYYCQQNNNWPTTFGQGTKLEIKR

SEQ ID NO: 13855 - protein, 216 aa, Mus musculus; identical to SEQ ID NO: 13811

SEQ ID NO: 13856 - protein, 221 aa, Mus musculus; identical to SEQ ID NO: 13812

SEQ ID NO: 13857 - protein, 220 aa, Mus musculus; identical to SEQ ID NO: 13813

SEQ ID NO: 13858 - protein, 220 aa, Mus musculus; identical to SEQ ID NO: 13817

SEQ ID NO: 13859 - protein, 220 aa, Mus musculus; identical to SEQ ID NO: 13815

SEQ ID NO: 13860 - protein, 216 aa, Mus musculus
LANIVMTQSHKFMSTLIGARVSITCKASQDVDTAVAWYQQKPGQSPKLLIYWASTRHTGVPDRFTGSGSGTDFSLTVSNVQSEDLTDYFCQQYSSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13861 - protein, 213 aa, Mus musculus
DIQMTQTSSSLSASLGDRVTISCRSSQDISNYLNWYQQKPDGTVKLLMYISRLHSGVPSRFSGSGSGTEYSLTISNLEQEDIATYFCQQGNTLPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13862 - protein, 222 aa, Mus musculus
LADIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQSDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13863 - protein, 216 aa, Mus musculus
LADIVMTQTTSSLSASLGDRVTISCRPSQDISNYVNWFQQKPGGTVKLLIFHTSRLHSGVPSRFSGSGSGTDYSLTISTLEQEDIAIYFCQQGITLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13864 - protein, 216 aa, Mus musculus
LADIVMTQATSSLSASLGDRVTVSCRASQDINNYLNWYQQKPDGTVKLLIYYTSRLQSGVPSRFSGSGSGIDYSLTISNLEQEDFVTYFCQQSETLPWTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13865 - protein, 221 aa, Mus musculus
LADIVLTQSPSSLAVSAGEKVTMSCKSSQSVLYISNERNYLAWYQQKPGQSPKLLIYWASTRKSGVPDRFTGSGSGTDFTLTISSVKAEDLAVYYCHQHLSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13866 - protein, 107 aa, Artificial Sequence
  Description of Artificial Sequence: Synthetic polypeptide
  Synthetic Polynucleotide used for CDR-H3 of anti-HER2 antibody
DIQMTQSPSSLSASVGDRVTITCRASQNIATDVAWYQQKPGKAPKLLIYSASFLYSGVPSRFSGSGSGTDFTLTISSLQPEDFATYYCQQSEPEPYTFGCGTKVEIK

SEQ ID NO: 13867 - protein, 111 aa, Mus sp.
QIVLTQSPAIMSASLGERVTMTCTVSSSVNSSYLHWYQQKPGSSPKLWIYSTSNLPSGVPARFSGSGSGTSYSLTISTIESEDAATYYCHQYHRSPQFTFGSGTKLEIKRA

SEQ ID NO: 13868 - protein, 112 aa, Mus sp.
DIVLTQSPASLAVSLGQRATISCRASESVDTFGYSFIYWYQQKPGQPPRLLIYRASNLESGIPARFSGSGSRTDFTLTINPVEADDVATYYCQQSNEDPPTFGGGTKLEIKR

SEQ ID NO: 13869 - protein, 113 aa, Mus sp.
DVVMSQIPLTLSVTIGQPASISCKSSQSLIHSDGKTYLNWLLQRPGQSPKRLIYLVSRLDSGVPDRFTGSGSGTDFTLKISRVEAEDLGVYYCWQGSHFPRTFGGGTKLEIKR

SEQ ID NO: 13870 - protein, 110 aa, Artificial Sequence
  Description of Artificial Sequence: Synthetic polypeptide
  Synthetic Construct
EIVLTQSPATMSASPGERVTMTCTVSSSVNSSYLHWYQQKPGSSPKLWIYSTSNLPSGVPARFSGSGSGTSYSLTISTIESEDAATYYCHQYHRSPQFTFGGGTKLEIKR

SEQ ID NO: 13871 - protein, 112 aa, Artificial Sequence
  Description of Artificial Sequence: Synthetic polypeptide
  Humanized antibody
DIVLTQSPDSLAVSLGERATISCRASESVDTFGYSFIYWYQQKPGQPPRLLIYRASNLESGIPDRFSGSGSRTDFTLTINPVEAEDVATYYCQQSNEDPPTFGGGTKLEIKR

SEQ ID NO: 13872 - protein, 112 aa, Artificial Sequence
  Description of Artificial Sequence: Synthetic polypeptide
  Humanized antibody
DIVLTQSPDSLAVSLGERATISCRASESVDTFGYSFIYWYQQKPGQPPRLLIYRASNLESGIPARFSGSGSRTDFTLTINPVEAEDVATYYCQQSNEDPPTFGGGTKLEIKR

SEQ ID NO: 13873 - protein, 112 aa, Artificial Sequence
  Description of Artificial Sequence: Synthetic polypeptide
  Humanized antibody
DIVLTQSPDSLAVSLGERATISCRASESVDTFGYSFIYWYQQKPGQPPRLLIYRASNLESGIPDRFSGSGSRTDFTLTINPVEADDVATYYCQQSNEDPPTFGGGTKLEIKR

SEQ ID NO: 13874 - protein, 113 aa, Artificial Sequence
  Description of Artificial Sequence: Synthetic polypeptide
  Synthetic Construct
DVVMTQTPLSLSVTLGQPASISCKSSQSLIHSDGKTYLNWLLQRPGQSPKRLIYLVSRLDSGVPDRFTGSGAGTDFTLKISRVEAEDLGVYYCWQGSHFPRTFGGGTKLEIKR

SEQ ID NO: 13875 - protein, 112 aa, Mus sp.
DIVLTQSPGSLAVSLGQRATISCRASESVDTYGNSFMHWYQQKAGQPPRLLIYRASNLESGIPARFSGSGSRTDFTLTINPVEADDVATYYCQQSNEDPLTFGAGTKLELKR

SEQ ID NO: 13876 - protein, 107 aa, Mus sp.
QIVLTQSPALMSASPGEKVTMTCSASSSVSYMYWYQQKPRSSPKPWIYITSNLASGVPARFSGSGSGTSYSLTISSMEAEDAATYYCQQWSSNPPTFGGGTKLEIKR

SEQ ID NO: 13877 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCVQYANYPYTFGQGTKLEIK

SEQ ID NO: 13878 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCVQYSNYPYTFGQGTKLEIK

SEQ ID NO: 13879 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCGQYANYPYTFGQGTKLEIK

SEQ ID NO: 13880 - protein, 107 aa, Artificial Sequence
  Description of Artificial Sequence: Synthetic polypeptide
  synthetic anti-EphA3 antibody light chain V-L region
DIQLTQSPSFLSASVGDRVTITCRASQGIISYLAWYQQKPEKAPKRLIYGASSLQSGVPSRFSGSGSGTEFTLTISSLQPEDFATYYCVQYANYPYTFGQGTKLEIK

SEQ ID NO: 13881 - protein, 107 aa, Artificial Sequence
  Description of Artificial Sequence: Synthetic polypeptide
  synthetic anti-EphA3 antibody light chain V-L region
DIQMTQSPSSLSASLGDRVTITCQASQDISTYLNWIQQKPGKAPKRLIYAASSLQSGVPSRFSGSGSGTEFTLTISSLQPEDFATYYCVQYANYPYTFGQGTKLEIK

SEQ ID NO: 13882 - protein, 107 aa, Artificial Sequence
  Description of Artificial Sequence: Synthetic polypeptide
  synthetic anti-EphA3 antibody light chain V-L region
DIQMTQSPSSLSASLGDRVTITCQASQDISTYLNWIQQKPGKAPKRLIYAASSLQRGVPSRFSGSGSGTEFTLTISSLQPEDFATYYCVQYANYPYTFGQGTKLEIK

SEQ ID NO: 13883 - protein, 107 aa, Artificial Sequence
  Description of Artificial Sequence: Synthetic polypeptide
  synthetic anti-EphA3 antibody light chain V-L region
DIQMTQSPSSLSASVGDRVTITCRASQSISSYLAWYQQKPGKAPKRLIYAASSLQRGVPSRFSGSGSGTEFTLTISSLQPEDFATYYCVQYANYPYTFGQGTKLEIK

SEQ ID NO: 13884 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCAQYANYPYTFGQGTKLEIK

SEQ ID NO: 13885 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCVQYAKYPYTFGQGTKLEIK

SEQ ID NO: 13886 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCVGYANYPYTFGQGTKLEIK

SEQ ID NO: 13887 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCVRYANYPYTFGQGTKLEIK

SEQ ID NO: 13888 - protein, 107 aa, Artificial Sequence
  Description of Artificial Sequence: Synthetic polypeptide
  synthetic anti-EphA3 antibody light chain V-L region
DIQMTQSPSFLSASVGDRVTITCRASQGIISYLAWYQQKPEKAPKRLIYAASSLQSGVPSRFSGSGSGTEFTLTISSLQPEDFATYYCVQYLNYPYTFGQGTKLEIK

SEQ ID NO: 13889 - protein, 107 aa, Artificial Sequence
  Description of Artificial Sequence: Synthetic polypeptide
  synthetic murine mIIIA4 and reference Fab FA4 Vk region
DIVLTQTPSSLSASLEERVSLTCRASQEISGYLGWLQQKPDGTIKRLIYAASTLDSGVPKKFSGNRSGSEYSLTISSLESEDFADYYCVQYANYPYTFGGGTKLEIK

SEQ ID NO: 13890 - protein, 107 aa, Artificial Sequence
  Description of Artificial Sequence: Synthetic polypeptide
  synthetic optimized reference Fab FA106 Vk region
DIVLTQTPSSLSASLEERVSLTCRASQEISGYLGWLQQKPDGTIKRLIYAASTLDSGVPKKFSGNRSGSEYSLTISSLESEDFATYYCVQYANYPYTFGQGTKLEIK

SEQ ID NO: 13891 - protein, 107 aa, Mus musculus
DTVMTQSHKIMSTSVGDRVSITCKASQDVSIGVAWYQQRPGQSPKLLIYSASYRYTGVPDRFTGSGSGTDFTFTISSVQAEDLAVYYCQQYYIYPYTFGGGTKLEIK

SEQ ID NO: 13892 - protein, 113 aa, Homo sapiens
DIVMTQSPDSLAVSLGERATITCKSSQSVFFRSNNKNCLAWYQQRPGQPPNLLIYWASTRESGVPDRFSGSGSGTDFTLTISSLQAEDVAVYYCQQYFGSPFTFGPGTKVDIK

SEQ ID NO: 13893 - protein, 107 aa, Homo sapiens
DIQMTQSPSSLSASVGDRVTITCRASQGISNHLAWFQQKPGKAPKSLIYGASSLQTGVPSKFSGSGSGTDFTLTISSLQPEDFASYFCQQYKGYPITFGQGTRLEIK

SEQ ID NO: 13894 - protein, 113 aa, Homo sapiens
DIVMTQSPDSLAVSLGERATITCKSSQSVFFRSNNKNCLTWYQQRPGQPPNLLIYWASTRESGVPDRFSGSGSGTDFTLTINNLQAEDVAVYYCQQYFGSPFTFGPGTKVDIK

SEQ ID NO: 13895 - protein, 113 aa, Homo sapiens
DIVMTQSPDSLAVSLGERATITCKSSQSVFFRSNNKNCLAWYQQRPGQPPNLLIYWASTRESGVPDRFSGSGCGTDFTLTISSLQAEDVAVYYCQQYFGSPFTFGPGTKVDIK

SEQ ID NO: 13896 - protein, 113 aa, Homo sapiens
DIVMTQSPDSLAVSLGERATITCKSSQSVFFRSNNKNCLAWYQQRPGQPPNLLFYWASTRESGVPDRFSGSGSGTDFTLTISSLQAEDVAVYYCQQYFGSPFTLGPGTKVDIK

SEQ ID NO: 13897 - protein, 113 aa, Homo sapiens
DIVMTQSPGSLVVSLGERATITCKSSQSVFFRSNNKNCLAWYQQRPGQSPNLLIYWASTRESGVPDRFSGSGSGTDFTLTISSLQAEDVAVYYCQQYFGSPFTFGPGTKVDIK

SEQ ID NO: 13898 - protein, 113 aa, Homo sapiens
DIVMTQSPDSLAVSLGERATITCKSSQSVFFRSNNKNCLAWYQQRPGQPPNLLIYWASSRESGVPDRFSGSGSGTDFALTISSLQTEDVAVYYCQQYFGSPFTFGPGTKVDIK

SEQ ID NO: 13899 - protein, 113 aa, Homo sapiens
DIVMTQFPDSLAVSLDERATINCKSSQSVFFRSNNKNCLAWYQQKPGQPPNLLIYWASTRESGVPDRFSGSGSGTDFTLTISSLQAEDVAFYYCQQYYSSPFTFGPGTKVDIK

SEQ ID NO: 13900 - protein, 112 aa, Homo sapiens; identical to SEQ ID NO: 7534

SEQ ID NO: 13901 - protein, 107 aa, Artificial Sequence
  Description of Artificial Sequence: Synthetic polypeptide
  Light Chain Variable Region
  MOD_RES (30)..(30): Asn or an amino acid having a side chain that is either nonpolar and/or is negative or positive in charge and/or may not be small
  MOD_RES (53)..(53): Phe or an amino acid having a side chain that is either polar and/or is charge positive or negative and/or is not large
  MOD_RES (92)..(92): Tyr or an amino acid having a side chain that is nonpolar and/or a side chain that is non-neutral and/or is not large
DIQMTQSPSSLSASVGDRVTITCRASQDVXTAVAWYQQKPGKAPKLLIYSASXLYSGVPSRFSGSRSGTDFTLTISSLQPEDFATYYCQQHXTTPPTFGQGTKVEIK

SEQ ID NO: 13902 - protein, 111 aa, Homo sapiens
QSALTQPPSASGSPGQSVTISCTGTSSDVGAYNDVSWYQHHPGKAPKLIIYEVNHRPSGVPDRFSGSKSDNTASLTISGLQAEDEADYYCSSYTPSNTPLVFGSGTKVTVL

SEQ ID NO: 13903 - protein, 110 aa, Homo sapiens
QPVLTQPPSVSAAPGQRVTISCSGSSSNIGNNYLSWYQQLPGTAPKLLIYDDTKRPSGIPDRFSGSKSGTSATLGITGLQTGDEADYYCGTWDGSLDAEVFGTGTKLTVL

SEQ ID NO: 13904 - protein, 108 aa, Homo sapiens
QTVVTQAPSVSVAPGQTARITCGGNNIGSKSVHWYQQKPGQAPVLVVYDDSDRPSGIPERFSGSNSGNTATLTISRVEAGDEADYYCQVWDSTSDHVVFGGGTKVTVL

SEQ ID NO: 13905 - protein, 108 aa, Homo sapiens
QSVLTQPPSVSVAPGNTATITCGGDNIGEKTVHWYQQRPGQAPALVIYYDSDRPSGIPERFSGSNSGNTATLTISRVEAGDEADYYCQVWDSSSDHVVFGGGTKLTVL

SEQ ID NO: 13906 - protein, 105 aa, Homo sapiens
IVLTQSPSSLSASVGDRVTITCQASHDISNYLTWYQHRPGRAPKLLIFDASRLETGVPSRFSGYGSGKDFTFTISGLQPEDFATYYCQHYADLPSFGQGTKLEIK

SEQ ID NO: 13907 - protein, 107 aa, Homo sapiens
QSVLTQPPSVSVAPGKTARITCGGNNIGSKSVHWYQQKPGQAPVLVIYYDSDRPSGIPERFSGSNSGNTATLTISRVEAGDEADYYCQVWDSSSDHLVFGTGTKLVT

SEQ ID NO: 13908 - protein, 112 aa, Homo sapiens
QAGLTQPPSASASPGDSVTLTCTLSSDHSDYKVDWYQQRPGKGPRFVMRVGTGGIVGVKVSNRFSGSKSGNTASLTISGLQAEDEADYYCSSYTDSSTLDVVFGGGTKLTVL

SEQ ID NO: 13909 - protein, 108 aa, Homo sapiens
SYELMQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKVTVL

SEQ ID NO: 13910 - protein, 108 aa, Homo sapiens
QAGLTQPPSVSVAPGKTARITCGGDNIGSKSVHWYQQKPGQAPVLVIYYDTDRPSGIPERFSGSNSGNTATLTISRVEAGDEADYYCQVWDSSSDPVVFGGGTKLTVL

SEQ ID NO: 13911 - protein, 110 aa, Homo sapiens
  MOD_RES (104)..(104): Any naturally occurring amino acid
QSVVTQPPSVSGAPGQRVTISCTGSSSNIGAGYEVHWYQHVPGTAPKLLIYINSNRPSGIPNRFSGSKSGNTAFLTISGLQAEDEADYYCISYTSSNTWVFGGXTKVTVL

SEQ ID NO: 13912 - protein, 111 aa, Homo sapiens
QSVLTQPPSASGSPGQSVTISCTGTSSDVGGYNFVSWYQQHPGKAPKLMIYDVTNRPSGVSNRFSGSKSGNTASLTISGLQAEDEADYYCSSYTSSSTPYVFGTGTKLTVL

SEQ ID NO: 13913 - protein, 108 aa, Homo sapiens
QPVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVL

SEQ ID NO: 13914 - protein, 106 aa, Homo sapiens
EIVLTQSPSSLSASVGDRVTITCQASHDISNYLTWYQHRPGRAPKLLIFDASRLETGVPSRFSGYGSGKDFTFTISGLQPEDFATYYCQHYADLPSFGQGTKVDIK

SEQ ID NO: 13915 - protein, 108 aa, Homo sapiens
SYELMQPPSVSVAPGKTARITCGGNNIGSKSVHWYQQKPGQAPVLVIYYDSDRPSGIPERFSGSNSGNTATLTISRVEAGDEADYYCQVWDSSRDHAVFGGGTKLTVL

SEQ ID NO: 13916 - protein, 108 aa, Homo sapiens
QAVVTQPPSVSVAPGQTARITCAGNNIGSKSVHWYQQKPGQAPVLVIFDDSDRPSGISERFSGSNSGNTATLTISRVEAGDEADYYCQVWDGDTDHVVFGGGTKLTVL

SEQ ID NO: 13917 - protein, 111 aa, Homo sapiens
QPVLTQPASVSGSPGQSITISCTGTSSDVGGYNYVSWYQQHPGKAPKLMIYDVSKRPSGVSNRFSGSKSGNTASLTISGLQAEDEADYYCSSYTSNSIYVFGTGTKVTVLG

SEQ ID NO: 13918 - protein, 110 aa, Homo sapiens
QSVVTQPPSVSAAPGQKVTISCSGSSSNIGNNYVSWYQQLPGTAPKLLIYDNNERPSGIPDRFSGSKSGTSATLGITGLQTGDEADYYCGTWDSSLSAGVFGGGTKLTVL

SEQ ID NO: 13919 - protein, 110 aa, Homo sapiens
QSVLTQPPSASGTPGQSVTISCSGSSSNIGGNTVNWYQQFPGTAPKLLMYINNLRPAGVPDRFSGSKSGTSASLVISGLQSEDEADYYCASWDDSLSGLVFGGGTKLTVL

SEQ ID NO: 13920 - protein, 108 aa, Homo sapiens
SYELMQPPSVSVAPGKTARITCGGNNIGSKSVHWYQQKPGQAPVVVIYYDSDRPSGIPERFSGSNSGNTATLTISRVEAGDEADYYCQVWDSSSDHYVFGTGTKLTVL

SEQ ID NO: 13921 - protein, 108 aa, Homo sapiens
QSVLTQPPSVSVAPGKTARITCGGNNIGSKSVHWYQQKPGQAPLLVIYYDTDRPSGIPERFSGSNSENTATLTISGVEAGDEADYYCQVWDIGSDQVVFGTGTKVTVL

SEQ ID NO: 13922 - protein, 111 aa, Homo sapiens
SYELTQPASVSGSPGQSITISCTGTSSDVGNYNSVSWYQQHPGKAPELMIYDVNNRPSGVSNRFSGSKSGNTASLTISGLQAEDEADYYCSSYTSSSTLVFGGGTQLTVLG

SEQ ID NO: 13923 - protein, 111 aa, Homo sapiens
QSVLTQPASVSGSPGQSITISCTGSSSDVGSYNLVSWYQQHPGKAPKLMIYDDNRRPSGISTRFSGSKSGNTASLTVSGLQAEDEAYYYCSSYAGRNNDVIFGGGTQLTVL

SEQ ID NO: 13924 - protein, 116 aa, Homo sapiens
QAGLTQPPSASASPGDSVTLTCTLSSDHSDYKVDWYQQRPGKGPRFVMRVGTGGIVGVKGDGIPDRFSVWGSGPNRYLTIKNIQEEDESDYHCGSDHGSGNNYVYVFGGGTKLTVL

SEQ ID NO: 13925 - protein, 110 aa, Homo sapiens
QSALTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAEVFGGGTKVTVL

SEQ ID NO: 13926 - protein, 111 aa, Homo sapiens
LPVLTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNPYVFGTGTKVTVL

SEQ ID NO: 13927 - protein, 111 aa, Homo sapiens
QSVLTQPPSVSGAPGQRVTISCTGSSSNIGAGYDVHWYQQLPGTAPKLLIYGNSNRPSGVPDRFSGSKSGNTASLTVSGLQAEDEADYYCASWDDSLNSPVFGGGTKLTVL

SEQ ID NO: 13928 - protein, 112 aa, Homo sapiens
QSVLTQPASVSGSPGQSITISCTGTSSDVGGYNFVSWYQQHPGKAPKLMIYDVTNRPSGVSNRFSGSKSGNTASLTISGLQAEDEADYYCSSYTDSSTLDVVFGGGTKVTVL

SEQ ID NO: 13929 - protein, 110 aa, Homo sapiens
  MOD_RES (104)..(104): Any naturally occurring amino acid
QSALTQPASVSGSPGQSITISCTGTTSDVGGYNYVSWYQQHPGKGPKLMIYDVSKRPSGVSGRFSGSKSGNTASLTISGLQAEDEADYYCSSYTSSSTLLFGGXTKLTVL

SEQ ID NO: 13930 - protein, 110 aa, Homo sapiens
QAGLTQPRSVSGSPGQSVTISCTGTSSDVGGYNYVSWYQQHPGKAPKLLIYDVNNRPSGVPDRFSGSKSGNTASLTISGLQAEDEADYYCSSYTSSTTQVFGGGTKVTVL

SEQ ID NO: 13931 - protein, 109 aa, Homo sapiens
QAGLTQPPSASGSPGQSVTISCTGTSSDVGGYNYVSWYQQHPGKAPKLMIYEVNKRPSGIPDRFSGSKSDSTASLTISGLQAEDEANYYCISYTSSTTWVFGGGTQLTV

SEQ ID NO: 13932 - protein, 107 aa, Artificial Sequence [sequence omitted]

SEQ ID NO: 13933 - protein, 111 aa, Artificial Sequence [sequence omitted]

SEQ ID NO: 13934 - protein, 110 aa, Artificial Sequence
  Description of Artificial Sequence: Synthetic polypeptide
QSVLTQPPSASGTPGQRVTISCSGSDSNIGRNYIYWYQQFPGTAPKLLIYRNNQRPSGVPDRISGSKSGTSASLAISGLRSEDEAEYHCGTWDDSLSGPVFGGGTKLTVL

SEQ ID NO: 13935 - protein, 106 aa, Artificial Sequence
  Description of Artificial Sequence: Synthetic polypeptide
QYELTQPPSVSVYPGQTASITCSGDQLGSKFVSWYQQRPGQSPVLVMYKDKRRPSEIPERFSGSNSGNTATLTISGTQAIDEADYYCQAWDSSTYVFGTGTKVTVL

SEQ ID NO: 13936 - protein, 108 aa, Artificial Sequence
  Description of Artificial Sequence: Synthetic polypeptide
QDIQMTQSPSSLSASVGDRITITCQASQDIGDSLNWYQQKPGKAPRLLIYDASNLETGVPPRFSGSGSGTDFTFTFRSLQPEDIATYFCQQSANAPFTFGPGTKVDIK

SEQ ID NO: 13937 - protein, 110 aa, Artificial Sequence
  Description of Artificial Sequence: Synthetic polypeptide
QYELTQPASVSGSPGQSITISCTGTSSDIGRWNIVSWYQQHPGKAPKLMIYDVSNRPSGVSNRFSGSKSGNTASLTISGLQAEDEADYYCSSYTSSSTWVFGGGTKLTVL

SEQ ID NO: 13938 - protein, 107 aa, Artificial Sequence
  Description of Artificial Sequence: Synthetic polypeptide
  Synthetic Construct
DIQMTQSPSSLSASVGDRVTITCRASQDVNTAVAWYQQKPGKAPKLLIYTTTWPYSGVPSRFSGSRSGTDFSLTISSLQPEDFATYYCQQYYNTPVTFGQGTKVEIK

SEQ ID NO: 13939 - protein, 112 aa, Artificial Sequence
  Description of Artificial Sequence: Synthetic polypeptide
  VL synthetic peptide
DIVMTQSPLSLPVTPGEPASISCRSSQSLVHSNGRTYLEWYLQKPGQSPQLLIYKVSNRISGVPDRFSGSGSGTDFTLKISRVEAEDVGVYYCFQGSHVPYTFGQGTKVEIK

SEQ ID NO: 13940 - protein, 112 aa, Artificial Sequence
  Description of Artificial Sequence: Synthetic polypeptide
  VL synthetic peptide
DVVMTQSPLSLPVSLGEPASISCRSSQSLVHSNGRTYLEWYLQKPGQSPKVLIYKVSNRISGVPDRFSGSGSGTDFTLKISRVEAEDVGVYFCFQGSHVPYTFGQGTKVEIK

SEQ ID NO: 13941 - protein, 112 aa, Artificial Sequence
  Description of Artificial Sequence: Synthetic polypeptide
  LV.4-3 of KM8035
DIVMTQSPLSLPVSLGEPASISCRSSQSLVHSNGRTYLEWYLQKPGQSPQVLIYKVSNRISGVPDRFSGSGSGTDFTLKISRVEAEDVGVYFCFQGSHVPYTFGQGTKVEIK

SEQ ID NO: 13942 - protein, 112 aa, Artificial Sequence
  Description of Artificial Sequence: Synthetic polypeptide
  LV.3-1 of VL of KM8036
DVVMTQSPLSLPVTPGEPASISCRSSQSLVHSNGRTYLEWYLQKPGQSPQVLIYKVSNRISGVPDRFSGSGSGTDFTLKISRVEAEDVGVYFCFQGSHVPYTFGQGTKVEIK

SEQ ID NO: 13943 - protein, 112 aa, Mus musculus
DVLMTQTPLSLPVSLGDQASISCRSSQSLVHSNGRTYLEWYLQKPGQSPKVLIYKVSNRISGVPDRFSGSGSGTDFTLKISRVEAEDLGVYFCFQGSHVPYTFGGGTKLEIK

SEQ ID NO: 13944 - protein, 109 aa, Rattus norvegicus
DIQMTQSPSSLSAFLGDRVTITCRASQDIGNYLRWFQQKPGKSPRLMIYGATNLANGVPSRFSGSRSGSDYSLTINNLESEDMAIYYCLKHNEYPFTFGSGTKLEIKRA

SEQ ID NO: 13945 - protein, 110 aa, Rattus norvegicus
DIQMTQSPASLSASLGETVTIECRASEDIYSNLAWYQQKPGNSPQLLIYDANILADGVPSRFSGSGSGTQYSLKINSLQSEDVASYFCQQYNNYPPFTFGVGTKLELKRA

SEQ ID NO: 13946 - protein, 110 aa, Rattus norvegicus
DIQMTQSPASLSASLGETVTIECRASEDIYSNLAWYQQKPGNSPQLLIYDANILADGVPSRFSGSGSGTQYSLKINSLQSEDVASYFCQQYNNYPPFTFGAGTKLELKRA

SEQ ID NO: 13947 - protein, 107 aa, Mus musculus
QIVLTQSPAIMSASPGEKVTITCSASSSVSYMHWFQQKPGTSPKLWIYSTSNLASGVPARFSGSGSGTSYSLTISRMEAEDAATYYCQQRSSYPYTFGGGTKLEIKR

SEQ ID NO: 13948 - protein, 108 aa, Artificial Sequence
  Description of Artificial Sequence: Synthetic polypeptide
  Amino Acid Sequence of Antibody Light Chain Variable Region
DIQLTQSPSSLSASVGDRVTITCSASSSVSYMHWYQQKPGKAPKLLIYSTSNLASGVPSRFSGSGSGTDFTFTISSLQPEDIATYYCQQRSSYPYTFGGGTKVEIKRT

SEQ ID NO: 13949 - protein, 108 aa, Artificial Sequence
  Description of Artificial Sequence: Synthetic polypeptide
  Amino Acid Sequence of Antibody Light Chain Variable Region
DIQMTQSPSSLSASVGDRVTITCSASSSVSYMHWYQQKPGKAPKLLIYSTSNLASGVPSRFSGSGSGTDFTLTISSLQPEDFATYYCQQRSSYPYTFGQGTKVEIKRT

SEQ ID NO: 13950 - protein, 108 aa, Artificial Sequence
  Description of Artificial Sequence: Synthetic polypeptide
  Amino Acid Sequence of Antibody Light Chain Variable Region
DIQLTQSPSSLSASPGDRVTITCSASSSVSYMHWFQQKPGKAPKLWIYSTSNLASGVPARFSGSGSGTSYSLTISRLQPEDIATYYCQQRSSYPYTFGGGTKVEIKRT

SEQ ID NO: 13951 - protein, 108 aa, Artificial Sequence
  Description of Artificial Sequence: Synthetic polypeptide
  Amino Acid Sequence of Antibody Light Chain Variable Region
DIQLTQSPSSLSASPGDRVTITCSASSSVSYMHWFQQKPGKAPKLWIYSTSNLASGVPSRFSGSGSGTSYSLTISRLQPEDIATYYCQQRSSYPYTFGGGTKVEIKRT

SEQ ID NO: 13952 - protein, 108 aa, Artificial Sequence
  Description of Artificial Sequence: Synthetic polypeptide
  Amino Acid Sequence of Antibody Light Chain Variable Region
DIQLTQSPSSLSASPGDRVTITCSASSSVSYMHWFQQKPGKAPKLWIYSTSNLASGVPSRFSGSGSGTSYSFTISSLQPEDIATYYCQQRSSYPYTFGGGTKVEIKRT

SEQ ID NO: 13953 - protein, 108 aa, Artificial Sequence
  Description of Artificial Sequence: Synthetic polypeptide
  Amino Acid Sequence of Antibody Light Chain Variable Region
DIQLTQSPSSLSASPGDRVTITCSASSSVSYMHWYQQKPGKAPKLWIYSTSNLASGVPSRFSGSGSGTSYSLTISRLQPEDIATYYCQQRSSYPYTFGGGTKVEIKRT

SEQ ID NO: 13954 - protein, 108 aa, Artificial Sequence
  Description of Artificial Sequence: Synthetic polypeptide
  Amino Acid Sequence of Antibody Light Chain Variable Region
DIQLTQSPSSMSASPGDRVTITCSASSSVSYMHWFQQKPGKSPKLWIYSTSNLASGVPSRFSGSGSGTSYSLTISSMQPEDFATYYCQQRSSYPYTFGQGTKLEIKRT

SEQ ID NO: 13955 - protein, 133 aa, Mus musculus
MDSQAQVLMLLLLWVSGTCGDIVMSQSPSSLAVSVGEKVTMSCKSSQSLLYSTNQKNSLAWYQQKPGQSPKLLIYWASTRESGVPDRFTGSGSGTDFTLTISSVKAEDLAVYYCQQYYRYPLTFGAGTKLELK

SEQ ID NO: 13956 - protein, 113 aa, Artificial Sequence
  Description of Artificial Sequence: Synthetic polypeptide
  Synthetic construct
DIVMTQSPDSLAVSLGERATINCKSSQSLLYSTNQKNSLAWYQQKPGQPPKLLIYWASTRESGVPDRFSGSGSGTDFTLTISSLQAEDVAVYYCQQYYRYPLTFGQGTKLEIK

SEQ ID NO: 13957 - protein, 106 aa, Mus musculus
  Variable Region of Light Chain(35-1)
QIVLTQSPAIMSASPGEKVTMTCSASSSVTYMYWYQQKPGSSPRLLIYDTSNLASGVPVRFSGSGSGTSYSLTISRMEAEDAATYYCQQWSSYPPTFGGGTKLEIK

SEQ ID NO: 13958 - protein, 106 aa, Mus musculus
  Variable Region of Light Chain(292)
QIVLTQSPAIMSASPGEKVTMTCSASSSISYMYWYQQRPGSSPRLLIYDTSNLASGVPVRFSGSGSGTSHSLTISRMEAEDAATYYCQQWSSYPSTFGGGTKLEIK

SEQ ID NO: 13959 - protein, 106 aa, Artificial Sequence
  Description of Artificial Sequence: Synthetic polypeptide
  Synthetic Humanized Variable Region of Light Chain (35-1)
QIVLTQSPTTMAASPGEKITITCSASSSVTYMYWYQQRPGFSPKLLIYDTSNLASGVPVRFSGSGSGTSYSLTIGTMEAEDVATYYCQQWSSYPPTFGGGTKLEIK

SEQ ID NO: 13960 - protein, 112 aa, Homo sapiens
DVVMTQSPLSLPVTLGQPASISCRSSQSLVYSDGNTYLNWFQQRPGQSPRRLIYKVSNWDSGVPDRFNGSGSGTDFTLKISRVEAEDVGVYYCMQSTHWPITFGQGTRLEIK

SEQ ID NO: 13961 - protein, 112 aa, Homo sapiens
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCIQGTHWPTTFGQGTRLEIK

SEQ ID NO: 13962 - protein, 112 aa, Homo sapiens
DVVMTQSPLSLPVTLGQPASISCRSSQSLVYSDGNTYLNWLQQRPGQSPRRLIYKVSNWDSGVPDRFSGSGSGTDFTLKISRVEAEDVGVYYCMQGTHWPITFGQGTRLEIK

SEQ ID NO: 13963 - protein, 112 aa, Homo sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQGIQLPCSFGQGTKLEIK

SEQ ID NO: 13964 - protein, 112 aa, Homo sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPLTFGGGTKVEIK

SEQ ID NO: 13965 - protein, 112 aa, Homo sapiens
DIVMTQTPLSLSVTPGQPASISCKSSQSLLHSDGKTYLYWFLQKPGQPPQPLIYEVSNRFSGVPDRFSGSGSGTDFTLKISRVEAEDVGVYYCMQSIQLPITFGHGTRLEIK

SEQ ID NO: 13966 - protein, 107 aa, Homo sapiens
DIQMTQSPSSLSASVGDRVTITCRASQGIANYLAWYQQKPGKVPKLLIYVASTLQSGVPSRFSGSGSGTDFTLTISSLQPEDVATYYCQNYNSAPFTFGPGTKVDIK

SEQ ID NO: 13967 - protein, 107 aa, Homo sapiens
DIQMTQSPSSLSASVGDRVTIICRASQGISNDLAWYQQKPGKVPKLLIYAASTLQSGVPSRFSGSGSGTDFTLTISSLQPEDVATYYCQKYNSVPLTFGGGTKVEIK

SEQ ID NO: 13968 - protein, 112 aa, Homo sapiens
NIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPHTFGPGTKVDIK

SEQ ID NO: 13969 - protein, 112 aa, Homo sapiens
EIVMTQTPLSSPVTLGQPASISCRSSQSLVHSDGNTYLSWLQQRPGQPPRLLIYKISNRFSGVPDRFSGTGAGTDFTLKISRVEAEDVGVYYCMQATQFPHTFGGGTKVEIK

SEQ ID NO: 13970 - protein, 108 aa, Homo sapiens
EIVLTQSPGTLSLSPGERATLSCRASQTVISSYLAWYQQKPGQAPRLLISGASSRATGIPDRFSGSGSGTDFTLTISRLEPEDFAVYYCQQYGSSPRTFGQGTKVEIK

SEQ ID NO: 13971 - protein, 106 aa, Homo sapiens
EIVLTQSPGTLSLSPGERATLSCRASQSVSRLAWYQQKPGQAPRLLIYGASRRATGIPDRFSGSGSGTDFTLTISRLEPEDFAVYYCQQYGSSPRSFGQGTKLEIK

SEQ ID NO: 13972 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPPTFGQGTKVEIK

SEQ ID NO: 13973 - protein, 113 aa, Homo sapiens
DIVMTQSPDSLAVSLGERATINCKSSQSVLYSSNNKNYLVWYQQKPGQPPKLFIYWASTRESGVPDRFTGSGSGTDFTLTISSLQAEDVAVYYCQQYYSFPWTFGQGTKVEIK

SEQ ID NO: 13974 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTTWTFGQGTKVEIK

SEQ ID NO: 13975 - protein, 113 aa, Homo sapiens
DIVMTQSPDSLAVSLGERATINCKSSQNVLYSSNNKNYLAWYQQKPGQPPKLLIYWASTRESGVPDRFSGSGSGTDFTLTISSLQAEDVAVYFCQQYYGTPRTFGQGTKVEIK

SEQ ID NO: 13976 - protein, 113 aa, Homo sapiens
DIVMTQSPDSLTVSLGERATINCKSSQSVLYSSNNKNYLAWYQQKPGQPPKLLIYWASTRESGVPDRFGGSGSGTDFTLTISSLQAEDVAVYYCQQYYSISRTFGQGTKVEIK

SEQ ID NO: 13977 - protein, 113 aa, Homo sapiens
DIVMTQSPDSLAVSLGERATINCKSSQSVLYNSNNKNYLAWYQQKPGQPPKLLIYWASTRESGVPDRFSGSGSGTDFTLTISSLQADDVAVYYCQQYYSTTWTFGPGTKVEIK

SEQ ID NO: 13978 - protein, 113 aa, Homo sapiens
DIVMTQSPDSLAVSLGERATINCKSSQSVLYSSNNKNYLAWYQQKPGQPPKVLIYWASTRKSGVPDRFSGSGSGTDFTLTISGLQAEDVALYYCQQYYSTMFSFGQGTKLEIK

SEQ ID NO: 13979 - protein, 113 aa, Homo sapiens
DIVMTQSPDSLAVSLGERATINCKSSQSVLDSSNNKNYLAWYQQKPGQPPKLLIYWASTRESGVPDRFSGSGSGTDFTLTISSLQAEDVAVFYCHQYYSTPLTFGGGTKVAIK

SEQ ID NO: 13980 - protein, 113 aa, Homo sapiens
DIVMTQSPDSLAVSLGERATINCKSSQSILYRSNNKNYLAWYQQKPGQPPKLLIYWASARESGVPDRFSGSGSGTDFTLTISSLQAEDVAVYFCQQYFITPLTFGGGTKVEIK

SEQ ID NO: 13981 - protein, 107 aa, Homo sapiens
DIQMTQSPSSLSASVGDRVTITCRASQDISHYLAWFQQKPGKAPKSLIYAASSLQSGVPSKFSGSGSGTDFTLTISSLQPEDFATYYCQQYNNYPFTFGPGTKVDIK

SEQ ID NO: 13982 - protein, 107 aa, Homo sapiens
DIQMTQSPSSLSASVGDRVAITCRASQDISNYLAWLQQKPGKAPKSLIYAASSLQSGVPSRFSGSGSGTDFTLTISSLQPEDFATYYCQQYNTYPFTFGPGTKMDIK

SEQ ID NO: 13983 - protein, 108 aa, Homo sapiens
EIVMTQSPATLSVSPGERATLSCRASQSVSSNLAWYQQDPGQAPRLLIYGASRRATGIPARFSGSGSGTEFTLTISSLQSEDFAVYYCQQHNNWPPWTFGQGTKVEIK

SEQ ID NO: 13984 - protein, 107 aa, Homo sapiens
DIQMTQSPSSVSASVGDRVTITCRASQDISRWLAWYQQKPGKAPKLLIYAASSLQSGVPSRFSGSGSGTDFTLTISSLQPEDFATYYCQQANSFPPTFGQGTKVEFK

SEQ ID NO: 13985 - protein, 107 aa, Homo sapiens
DIQMTQSPSSLSASVGDRVTITCRASQSISTYLNWYQQKPGKAPKFLIYAASSLQSGVPSRFSGSGSGTDFTLTISSLQPEDFAAYYCQQSHSAPFTFGPGTKVDIK

SEQ ID NO: 13986 - protein, 106 aa, Homo sapiens
DIQMTQSPSSLSASLGDRVTITCRASQTISIYLNWYQQKPGKAPKLLIYAASSLQSGVPSRFSGSGSGTDFTLTISSLQPEDFATYYCQQSYSTLTFGGGTKVEIK

SEQ ID NO: 13987 - protein, 107 aa, Homo sapiens
DIQMTQSPSSLSASVGDRVTITCRASQSIRSYLNWYQQRPGNAPKLLIYAASSLQSGVPSRVSGSGSGTDFTLTIRSLQPEDFATYYCQQSYSIPLTFGGGTKVEIK

SEQ ID NO: 13988 - protein, 107 aa, Homo sapiens
DIQMTQSPSSRSASVGDRVTITCRASQTISRYLNWYQQKPGKAPKLLIYAASTLQSGVPSRFSGSGSGTDFTLTLSSLQPEDFATYYCQQIYSTSITFGQGTRLEIK

SEQ ID NO: 13989 - protein, 107 aa, Homo sapiens
DIQMTQSPSSLSASVGDRVTITCRASQRISSYLNWYQQKPGKAPKVLIYAESSLQSGVPSRFSGSGSGTDFTLTISSLQPEDFATYYCQQSYITPITFGQGTRLEII

SEQ ID NO: 13990 - protein, 107 aa, Homo sapiens
DIQMTQSPSSLSASVGDRVTITCRASQSISRYLNWYQQKPGKAPKLLIYTASSLQSGVPSRFSGSGSGTDFTLTISSLQPENFATYYCQQSYFTPITFGQGTRLEIK

SEQ ID NO: 13991 - protein, 107 aa, Homo sapiens
DIQMTQSPSSLSASVGDRVTITCRASQSISSYLNWYQQKPGKAPKLLIYTASSLQSGVPSRFSGSGSGTDFTLTFSSLQPEDFATYYCQQSYFSPITFGQGTRLEIK

SEQ ID NO: 13992 - protein, 107 aa, Homo sapiens
DIQMTQSPSSLSASVGDRVTITCRASQSISSYLNWYQQKPGKAPKLLIYTASSLQSGVPSRFSGSGSGTDFTLTLSSLQPEDFASYYCQQSFYTPITFGQGTRLEIK

SEQ ID NO: 13993 - protein, 107 aa, Homo sapiens
DIQMTQSPSSLSASVGDRVTITCRASQSISSYLNWYQQKPGKAPKLLIYTVSSLQSGVPSRFSGSGSGTDFTLTISSLQPEDFATYYCQQSYFTPITFGQGTRLEIK

SEQ ID NO: 13994 - protein, 107 aa, Homo sapiens
DIQMTQSPSSLSASVGDRVTITCRASQSISSYLNWYQQKPGKAPKLLIYTASSLQSGVPSRFSGSGSGTDFTLTISSLQPEDFASYYCQQSFYAPITFGQGTRLEIK

SEQ ID NO: 13995 - protein, 107 aa, Homo sapiens
DIQMTQSPSSLSASVGDRVTITCRASQSISSYLNWYQQKPGKAPKLLIYTASSLQSGVPSRFSGSGSGTDFTLTISSLQPEDFATYYCQQSYFTPITFGQGTRLEIK

SEQ ID NO: 13996 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDYLPFTFGPGTKVDIK

SEQ ID NO: 13997 - protein, 107 aa, Homo sapiens
DIQMTQSPSSLSASVGDRVTITCQASQDISNSLNWYQQKPGKAPELLIYDASNLETGVPSRFSGSGSGTDFTFTISSLQPEDIATYYCQQCDDLPLTFGGGTKVEIK

SEQ ID NO: 13998 - protein, 107 aa, Homo sapiens
DIQMTQSPSSLSASVGDRVTITCQASQDISDYLNWYQQKPGKAPKLLIYDASNLETGVPSRFSGSGSGTDFTFTISSLQPEDIATYYCQHYDNLPLTFGGGTKVEIK

SEQ ID NO: 13999 - protein, 107 aa, Homo sapiens
DIQMTQSPSSLSASVGDRVAITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 14000 - protein, 107 aa, Homo sapiens
DIQMTQSPSSLSASVGDRVTITCQASQDISNSLNWYQQKPGKAPKLLIYDASILETGVPSRFSGSGSETDFTFTISSLQPEDIATYYCQQCDILPLSFGGGTKVEIK

SEQ ID NO: 14001 - protein, 107 aa, Homo sapiens
DIQMTQSPSSLSASVGDRVTITCQASQDISNSLNWYQQKPGKAPKLLIYDASNLETGVPSRFSGSGSGTDFTFTISSLQPEDIATYYCQQYDNLPLAFGGGTKVEIR

SEQ ID NO: 14002 - protein, 107 aa, Homo sapiens
DIQMTQSPSSLSASVGDGVTITCQASQDITNYLNWYQQKPGKAPKLLIYDASNLETGVPSRFSGSGSGTDFTFTISSLQPEDIATYYCQQYDSLPITFGQGTRLEIK

SEQ ID NO: 14003 - protein, 107 aa, Homo sapiens
DIQMTQSPSSLSASVGDRVTITCQASQDISNYLNWYQQKLGKAPKLLIHDASNLETGVPSRFSGSGSGTDFTFTISSLQPEDIATYYCQQYDNLPITFGQGTRLEIK

SEQ ID NO: 14004 - protein, 107 aa, Homo sapiens
DIQMTQSPSSLSASVGDRVTITCQASQDISDYLNWYQQKPGKAPKLLIYDASNLETGVPSRFSGSGSGTDFTFTISSLQPEDIATYYCQHYDNLPITFGQGTRLEIK

SEQ ID NO: 14005 - protein, 107 aa, Homo sapiens
DIQMTQSPSSLSASVGDRVTITCQASQDISNSLNWYQQKPGKAPKLLIYDASNLETGVPSRFSGSGSGTDFTFTISSLQPEDIATYYCQHYDNLPITFGQGTRLEIK

SEQ ID NO: 14006 - protein, 108 aa, Artificial Sequence
  Description of Artificial Sequence: Synthetic polypeptide
DIQMTQSPSSLSASVGDRVTITCRASQDVSTAVAWYQQKPGKAPKLLIYSASFLYSGVPSRFSGSGSGTDFTLTISSLQPEDFATYYCQQSYPTPYTFGQGTKVEIKR

SEQ ID NO: 14007 - protein, 108 aa, Artificial Sequence
  Description of Artificial Sequence: Synthetic polypeptide
DIQMTQSPSSLSASVGDRVTITCRASQDLATDVAWYQQKPGKAPKLLIYSASFLYSGVPSRFSGSGSGTDFTLTISSLQPEDFATYYCQQSEPEPYTFGQGTKVEIKR

SEQ ID NO: 14008 - protein, 121 aa, Artificial Sequence
  Description of Artificial Sequence: Synthetic polypeptide
EVQLVESGGGLVQPGGSLRLSCAASGFTLSGDWIHWVRQAPGKGLEWLGEISAAGGYTDYADSVKGRFTISADTSKNTAYLQMNSLRAEDTAVYYCARESRVSFEAAMDYWGQGTLVTVSS

SEQ ID NO: 14009 - protein, 108 aa, Artificial Sequence
  Description of Artificial Sequence: Synthetic polypeptide
DIQMTQSPSSLSASVGDRVTITCRASQNIATDVAWYQQKPGKAPKLLIYSASFLYSGVPSRFSGSGSGTDFTLTISSLQPEDFATYYCQQSEPEPYTFGQGTKVEIKR

SEQ ID NO: 14010 - protein, 112 aa, Artificial Sequence
  Description of Artificial Sequence: Synthetic polypeptide
DIQMTQSPSSLSASVGDRVTITCRASQAVWGGYIAPVAWYQQKPGKAPKLLIYDGSYLYSGVPSRFSGSGSGTDFTLTISSLQPEDFATYYCQQRLPTPYTFGQGTKVEIKR

SEQ ID NO: 14011 - protein, 112 aa, Artificial Sequence
  Description of Artificial Sequence: Synthetic polypeptide
DIQMTQSPSSLSASVGDRVTITCRANQSIAGAYYAPVAWYQQKPGKAPKLLIYDGYFLYSGVPSRFSGSGSGTDFTLTISSLQPEDFATYYCQQRLPSPYTFGQGTKVEIKR

SEQ ID NO: 14012 - protein, 112 aa, Artificial Sequence
  Description of Artificial Sequence: Synthetic polypeptide
DIQMTQSPSSLSASVGDRVTITCRASQSLWAAYFAPVAWYQQKPGKAPKLLIYDGSYLYSGVPSRFSGSGSGTDFTLTISSLQPEDFATYYCQQRLPSPYTFGQGTKVEIKR

SEQ ID NO: 14013 - protein, 110 aa, Artificial Sequence
  Description of Artificial Sequence: Synthetic polypeptide
DIQMTQSPSSLSASVGDRVTITCRASQDVLFYGNVAWYQQKPGKAPKLLIYDGSYLYSGVPSRFSGSGSGTDFTLTISSLQPEDFATYYCQQSYPAPYTFGQGTKVEIKR

SEQ ID NO: 14014 - protein, 107 aa, Artificial Sequence; identical to SEQ ID NO: 13891
  Description of Artificial Sequence: Synthetic polypeptide

SEQ ID NO: 14015 - protein, 109 aa, Artificial Sequence
  Description of Artificial Sequence: Synthetic polypeptide
  Humanized Antibody Sequence
DTVMTQSHKIMSTSVGDRVSITCKASQDVSIGVAWYQQRPGQSPKLLIYSASYRYTGVPDRFTGSGSGTDFTFTISSVQAEDLAVYYCQQYYIYPYTFGGGTKLEIKRT

SEQ ID NO: 14016 - protein, 109 aa, Artificial Sequence
  Description of Artificial Sequence: Synthetic polypeptide
  Humanized Antibody Sequence
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRT

SEQ ID NO: 14017 - protein, 107 aa, Homo sapiens
EIVLTQSPGTLSLSPGERATLSCRASQSVSSSYLAWYQQKPGQVPRLLIYGASSRATGIPDRFSGSGSGTDFTLTISRLEPEDFAVYYCQQYGSSLTFGGGTKVEIK

SEQ ID NO: 14018 - protein, 108 aa, Homo sapiens [sequence omitted]

SEQ ID NO: 14019 - protein, 108 aa, Homo sapiens
EIVLTQSPGTLSLSPGERATLSCRASQSVSSTYLAWYQQKPGQAPRLLIYGASSRATGIPDRFSGSGSGTDFTLTISRLEPEDFAVYYCQQYGTSLFTFGPGTKVDIK

SEQ ID NO: 14020 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPITFGQGTRLEIK

SEQ ID NO: 14021 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFTFGPGTKVDIK

SEQ ID NO: 14022 - protein, 107 aa, Homo sapiens
EIVLTQSPGTLSLSPGERATLSCRASQSVRSSYLAWYQQKPGQAPRLLIYGASSRATGIPDRFSGSGSGTDFTLTISRLEPEDFAVYYCQLYGSSPTFGPGTKVDIK

SEQ ID NO: 14023 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 14024 - protein, 107 aa, Homo sapiens
EIVLTQSPGTLSLSPGERATLSCRASQSVSSSYLTWYQQKPGQAPRLLIYGASSRATGIPDRFSGSGSGTDFTLTISRLEPEDFAVYYCQQYGSSLTFGGGTKVEIK

SEQ ID NO: 14025 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRLTFGGGTKVEIK

SEQ ID NO: 14026 - protein, 107 aa, Homo sapiens; identical to SEQ ID NO: 4444

SEQ ID NO: 14027 - protein, 107 aa, Homo sapiens
DIQMTQSPSSVSASVGDRVTITCRASQGISSWLAWYQHKPGKAPKLLIYAASILQSGVPSRFSGSGSGTDFTLTISSLQPEDFATYYCQQANSFPITFGQGTRLEIK

SEQ ID NO: 14028 - protein, 107 aa, Homo sapiens
DIQMTQSPSSVSASVGDRVTITCRASQGISSWLAWYQHKPGKAPKLLIYVASTLQSGVPSRFSGSGSGTDFTLTISSLQPEDFATYYCQQANSFPLTFGGGTKVEIK

SEQ ID NO: 14029 - protein, 107 aa, Homo sapiens
DIQMTQSPSSLSASVGDRVTITCRASQGISRWLAWYQQKPEKAPKSLIYAASSLRSGVPSRFSGSGSGTDFTLTISSLQPEDFATYYCQQYNSYPITFGQGTRLEIK

SEQ ID NO: 14030 - protein, 106 aa, Homo sapiens; identical to SEQ ID NO: 13176

SEQ ID NO: 14031 - protein, 107 aa, Homo sapiens
VIWMTQSPSLLSASTGDRVTISCRMSQGISSYLAWYQQKPGKAPELLIYAASTLQSGVPSRFSGSGSGTDFTLTISYLQSEDFATYYCQQYYSFPLTFGGGTKVEIK

SEQ ID NO: 14032 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYYIYPWTFGQGTKVEIK

SEQ ID NO: 14033 - protein, 107 aa, Homo sapiens
DIQMTQSPSSLSASVGDRVTITCRASQGISSWLAWYQQKPEKAPKSLIYDASSLQSGVPSRFSGSGYGTDFSLTISSLQPEDFAIYYCQQYKSYPITFGQGTRLEIK

SEQ ID NO: 14034 - protein, 108 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIK

SEQ ID NO: 14035 - protein, 107 aa, Homo sapiens
DIQMTQSPSSVSASVGDRVTITCRASQGISSWLAWYQHKPGKAPKLLIYAASILQSGVPSRFSGSGSGTDFTLTISSLRPEDFATYYCQQANSFPITFGQGTRLEIK

SEQ ID NO: 14036 - protein, 107 aa, Homo sapiens
EIVLTQSPATLSLSPGERATLSCRASQSVSSYLAWYQQKPGQAPRLLIYDTSNRATGIPARFSGSGSGTDFTLTISSLEPEDFAVYYCQQRSHWPRTFGQGTKVEIK

SEQ ID NO: 14037 - protein, 107 aa, Homo sapiens
DIQMTQSPSSLSASVGDRVTITCRASQGISSWLAWYQQKPEKAPKSLIFAASSLQSGVPSRFSGSGSGTDFTLTISSLQPEDFATYYCQQYISFPITFGQGTRLEIK

SEQ ID NO: 14038 - protein, 107 aa, Homo sapiens
DIQMTQSPSSLSASVGDRVTITCRASQGISSWLAWYQQKPEKAPKSLIYAASRLQSGVPSRFSGSGSGTDFTLTISSLQPEDFATYYCQQYNSYPITFGQGTRLEIK

SEQ ID NO: 14039 - protein, 107 aa, Homo sapiens
DIQMTQSPSSLSASVGDRVTITCRASQGISSWLAWYQQKPEKAPKSLIYATFRLQSGVPSRFSGSGSGTDFTLTISSLQPEDFATYYCQQYNSFPPTFGQGTKVEIK

SEQ ID NO: 14040 - protein, 107 aa, Homo sapiens
DIQMTQSPSSLSASVGDRVTITCRASQGISSWLTWYQQKPEKAPKSLIYAASRLQSGVPSRFSGSGSGTDFTLTISSLQPEDFATYYCQQYNSFPPTFGQGTKVEIK

SEQ ID NO: 14041 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNSFPPTFGGGTKVEIK

SEQ ID NO: 14042 - protein, 107 aa, Homo sapiens
DIQMTQSPSSLSASVGDRVTITCRASQGISSWLVWYQQKPEKAPKSLIYAASSLQSGVPSRFSGSGSGTDFTLTISSLQPEDFATYYCQQYNSFPPTFGQGTKVEIK

SEQ ID NO: 14043 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 14044 - protein, 107 aa, Homo sapiens
DIQMTQSPSSLSASVGDRVTITCRASQGINSWLAWYQQKPEKAPKSLIYAASSLQSGVPSRFSGSGSGTDFTLTISSLQPEDFATYYCQQYNSYPYTFGQGTKLEIK

SEQ ID NO: 14045 - protein, 107 aa, Homo sapiens; identical to SEQ ID NO: 8705

SEQ ID NO: 14046 - protein, 107 aa, Homo sapiens; identical to SEQ ID NO: 4454

SEQ ID NO: 14047 - protein, 107 aa, Homo sapiens
DIQMTQSPSSLSASVGDRVTITCRASQDISSWLAWYQQKPEKAPKSLIYAASSLQSGVPSRFSGSGSGTDFTLTISSLQPEDFATYYCQQYNSYPITFGQGTRLEIK

SEQ ID NO: 14048 - protein, 107 aa, Homo sapiens
DIQMTQSPSSLSASVGDRVTITCRASQGISNWLAWYQQKPEKAPKSLIYDASSLQSGVPSRFSGSGSGTDFTLTISSLQPEDFATYYCQQYNSYPITFGQGTRLEIK

SEQ ID NO: 14049 - protein, 107 aa, Homo sapiens
DIQMTQSPSSLSASVGDRVTITCRASQGINSWLAWYQQKPEKAPKSLIYDASSLQSGVPSRFSGSGSGTDFTLTISSLQPENFATYYCQQYNSYPITFGQGTRLEIK

SEQ ID NO: 14050 - protein, 108 aa, Artificial Sequence
  Description of Artificial Sequence: Synthetic polypeptide
  Synthetic (light chain variable region of anti-Her2 antibody)
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 14051 - protein, 111 aa, Artificial Sequence
  Description of Artificial Sequence: Synthetic polypeptide
  Synthetic Amino acid sequence of light chain variable region of anti-HER2 antibody 41-B11
QTVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGIWVFGGGTKLTVLG

SEQ ID NO: 14052 - protein, 111 aa, Artificial Sequence
  Description of Artificial Sequence: Synthetic polypeptide
  Synthetic Amino acid sequence of light chain variable region of anti-HER2 antibody 41-C6
QTVVTQEPSSSVSPGGTVTLTCGLTSGSVSTSYYPSWYQQTPGQAPRTLIYSTNTRSSGVPDRFSGSILGNKAALTITGAQADDESDYYCMLYLGGGISVFGGGTKLTVLG

SEQ ID NO: 14053 - protein, 111 aa, Artificial Sequence
  Description of Artificial Sequence: Synthetic polypeptide
  Synthetic Amino acid sequence of light chain variable region of anti-HER2 antibody 41-E1
QPVLTQPHSVSESPGKTVTISCTRSSGSIDSNFVQWYQQRPGSSPTTVIYDDNQRPSGVPDRFSGSIDSSSNSASLTISGLKIEDEADYYCQSYDSNNQVFGGGTKLTVLR

SEQ ID NO: 14054 - protein, 111 aa, Artificial Sequence
  Description of Artificial Sequence: Synthetic polypeptide
  Synthetic Amino acid sequence of light chain variable region of anti-HER2 antibody 44-C12
QTVVTQEPSFSVSPGGTVTLTCGLSSGSVSPTYYPSWYQQTPGQAPRTLIYRTNIRSSGVPDRFSGSILGNKAALTITGAQADDESLYYCLLYMGSGVSLFGGGTKLTVLR

SEQ ID NO: 14055 - protein, 111 aa, Artificial Sequence
  Description of Artificial Sequence: Synthetic polypeptide
  Synthetic Amino acid sequence of light chain variable region of anti-HER2 antibody 44-H4
QAVVTQEPSFSVSPGGTVTLTCGLSSGSVSTSYYPSWYQQTPGQAPRTLIYSTNTRSSGVPDRFSGSILGNKAALTITGAQTDDESDYYCVLYMGSGISLFGGGTKVTVLG

SEQ ID NO: 14056 - protein, 107 aa, Artificial Sequence
  Description of Artificial Sequence: Synthetic polypeptide
  Amino acid sequence of 1E11 light chain variable region
DIQMTQSPASQSASLGESVTITCLASQTIGTWLAWYQQKPGKSPQLLIYVATSLADGVPSRFSGSGSGTKFSFKISSLQAEDFVSYYCQQLYSTPWTFGGGTKLELK

SEQ ID NO: 14057 - protein, 107 aa, Artificial Sequence
  Description of Artificial Sequence: Synthetic polypeptide
  Amino acid sequence of hz1E11 light chain variable region
DIQMTQSPSSLSASVGDRVTITCLASQTIGTWLAWYQQKPGKAPKLLIYVATSLADGVPSRFSGSGSGTDFTLTISSLQPEDFATYYCQQLYSTPWTFGQGTKVEIK

SEQ ID NO: 14058 - protein, 107 aa, Artificial Sequence
  Description of Artificial Sequence: Synthetic polypeptide
  Amino acid sequence of hz1E11-3 light chain variable region
DIQMTQSPSSLSASVGDRVTITCLASQTIGTWLAWYQQKPGKAPKLLIYVATSLADGVPSRFSGSGSGTDFTLTISSLQPEDFATYYCDQMYSTPWTFGQGTKVEIK

SEQ ID NO: 14059 - protein, 107 aa, Artificial Sequence
  Description of Artificial Sequence: Synthetic polypeptide
  Amino acid sequence of hz1E11-133 light chain variable region
DIQMTQSPSSLSASVGDRVTITCLASQTIGTWLAWYQQKPGKAPKLLIYVATSLADGVPSRFSGSGSGTDFTLTISSLQPEDFATYYCQQNAYAPWTFGQGTKVEIK

SEQ ID NO: 14060 - protein, 107 aa, Artificial Sequence
  Description of Artificial Sequence: Synthetic polypeptide
  Amino acid sequence of hz1E11-154 light chain variable region
DIQMTQSPSSLSASVGDRVTITCLASQTIGTWLAWYQQKPGKAPKLLIYVATSLADGVPSRFSGSGSGTDFTLTISSLQPEDFATYYCQQTAFSPWTFGQGTKVEIK

SEQ ID NO: 14061 - protein, 139 aa, Artificial Sequence
  Description of Artificial Sequence: Synthetic polypeptide
  Synthetic construct
MEWIWIFLFIFSGTAGVHSQVQLQQSGAELARPGASVKLSCKASGYTFTDNYINWMKQRPGQGLEWIGEIYPGSGNTYYNEKFKGKATLTADKSSSTAYMQLSSLTSEESAVYFCARSPNLRLYYFDYWGQGTTLTVSS

SEQ ID NO: 14062 - protein, 131 aa, Artificial Sequence
  Description of Artificial Sequence: Synthetic polypeptide
  Synthetic construct
METDTLLLWVLLLWVPGSTGDIVLTQSPASLAVSLGQRATISCRASESVDSYGNSFMNWYQQKPGQPPKVLIYRASNLESGIPARFSGSGSRTDFTLTITPVEADDVATYYCQQSYEDPPTFGGGTKLEIK

SEQ ID NO: 14063 - protein, 110 aa, Artificial Sequence
  Description of Artificial Sequence: Synthetic polypeptide
QYELTQPPSASGTPGQRVTMSCSGSSSNIGLNYVSWYQQLPGTAPKLLISRNNQRPSGVPDRFSGSKSGTSASLAISGLRSEDEADYYCAAWDDSLSGEVFGGGTKLTVL

SEQ ID NO: 14064 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSLSGEVFGGGTKLTVL

SEQ ID NO: 14065 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSLPGEVFGGGTKLTVL

SEQ ID NO: 14066 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 14067 - protein, 110 aa, Artificial Sequence
  Description of Artificial Sequence: Synthetic polypeptide
QSVLTQPPSASGTPGQRVTISCSGSLSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 14068 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSPSGEAFGGGTKLTVL

SEQ ID NO: 14069 - protein, 110 aa, Artificial Sequence
  Description of Artificial Sequence: Synthetic polypeptide
QSVLTQPPSASGTPGQRVTISCRGSSSNIGLNYVSWYQQLPGTAPKLLISRNNQRPSGVPDRFSGSKSGTSASLAISGLRSEDEADYYCAAWDDSPPGEAFGGGTKLTVL

SEQ ID NO: 14070 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDGLPGEVFGGGTKLTVL

SEQ ID NO: 14071 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSLIGEVFGGGTKLTVL

SEQ ID NO: 14072 - protein, 110 aa, Artificial Sequence
  Description of Artificial Sequence: Synthetic polypeptide
QSVLTQPPSASGTPGQRVTISCRGSSSNIGLNYVSWYQQLPGTAPKLLISRNNQRPSGVPDRFSGSKSGTSASLAISGLRSEDEADYYCAAWDDSLSGEVFGGGTKLTVL

SEQ ID NO: 14073 - protein, 110 aa, Artificial Sequence
  Description of Artificial Sequence: Synthetic polypeptide
QSVLTQPPSASGTPGQRVTISCSGSLSNIGLNYVSWYQQLPGTAPKLLISRNNQRPSGVPDRFSGSKSGTSASLAISGLRSEDEADYYCAAWDDSLSGEVFGGGTKLTVL

SEQ ID NO: 14074 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSLSGEAFGGGTKLTVL

SEQ ID NO: 14075 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSPSGEVFGGGTKLTVL

SEQ ID NO: 14076 - protein, 110 aa, Artificial Sequence
  Description of Artificial Sequence: Synthetic polypeptide
QSVLTQPPSASGTPGQRVTISCSGSSSNIGLNYVSWYQQLPGTAPKLLISRNNQRPSGVPDRFSGSKSGTSASLAISGLRSEDEADYYCAAWDDSLRGEVFGGGTKLTVL

SEQ ID NO: 14077 - protein, 111 aa, Artificial Sequence
  Description of Artificial Sequence: Synthetic polypeptide
  Humanized antibody sequence
AYDMTQTPASVEVAVGGTVTIKCQASQSISSWLAWYQQKPGQPPKLLIYQASKLASGVPSRFKGSGSGTEFTLTISGVECADAATYYCQQAYSVSNVDNAFGGGTEVVVKR

SEQ ID NO: 14078 - protein, 111 aa, Artificial Sequence
  Description of Artificial Sequence: Synthetic polypeptide
  Humanized antibody sequence
DIQMTQSPSTLSASVGDRVTITCQASQSISSWLAWYQQKPGKAPKLLIYQASKLASGVPSRFSGSGSGTEFTLTISSLQPDDFATYYCQQAYSVSNVDNAFGGGTKVEIKR

SEQ ID NO: 14079 - protein, 111 aa, Artificial Sequence
  Description of Artificial Sequence: Synthetic polypeptide
  Humanized antibody sequence
AYDMTQTPASVEIAVGGTVTIRCQASEDIESYLAWYQQKPGQPPKLLIYRASDLASGVSSRFKGSGSGTDYTLTISGVECDDAATYYCQQGYTIDNVDNTFGGGTEVVVKR

SEQ ID NO: 14080 - protein, 111 aa, Artificial Sequence
  Description of Artificial Sequence: Synthetic polypeptide
  Humanized antibody sequence
AYDMTQSPASVEAAVGGTVTIRCQASEDIESYLAWYQQKPGQPPKLLIYRASDLASGVSSRFKGSGSGTDYTLTISGLEPEDAATYYCQQGYTIDNVDNTFGGGTKVEIKR

SEQ ID NO: 14081 - protein, 111 aa, Artificial Sequence
  Description of Artificial Sequence: Synthetic polypeptide
  Humanized antibody sequence
AYDMTQTPASMEVAVGGTVTIKCQASQSISTYLAWYQQKPGQPPKLLIYDASDLASGVSSRFKGSGSGTQFTLTISGVECDDAATYYCQQDWSDSNVDNAFGGGTEVVVKR

SEQ ID NO: 14082 - protein, 116 aa, Artificial Sequence
  Description of Artificial Sequence: Synthetic polypeptide
  Humanized antibody sequence
ADIVMTQTPSSVEAAVGGTVTIKCQASENIYRLLAWYQQKPGQRPKLLIYSASTLASGVPSRFKGSGSGTQFTLTISDLECADAATYYCQNYYYSSRSSYDTYNVFGGGTEVVVKR

SEQ ID NO: 14083 - protein, 109 aa, Artificial Sequence
  Description of Artificial Sequence: Synthetic polypeptide
  Humanized antibody sequence
QVLTQTPPSVSAVVGGTVTINCQSSQRIYSNWLSWYQQKPGQTPKPLIYAASSLASGVPSRFKGSGSGTQFTLTISDLECDDAASYYCAGYYSGHIYSFGGGTEVVVKR

SEQ ID NO: 14084 - protein, 110 aa, Artificial Sequence
  Description of Artificial Sequence: Synthetic polypeptide
  Humanized antibody sequence
DIQMTQSPSSVSASVGDRVTITCQSSQRIYSNWLSWYQQKPGKAPKLLIYAASSLASGVPSRFSGSGSGTDFTLTISSLQPEDFATYYCAGYYSGHIYSFGGGTKVEIKR

SEQ ID NO: 14085 - protein, 113 aa, Artificial Sequence
  Description of Artificial Sequence: Synthetic polypeptide
  Humanized antibody sequence
AVLTQTPSPVSAAVGGTVTIKCQSSQSVYNNNLLSWYQQKPGQPPKLLIWGASYLPSGVPDRFSGSGSGTQFTLTISGVQCDDAATYYCLGGYDGDADTYNTFGGGTEVVVKR

SEQ ID NO: 14086 - protein, 111 aa, Artificial Sequence
  Description of Artificial Sequence: Synthetic polypeptide
  Humanized antibody sequence
AYDMTQTPASVEVAVGGTVTIKCQVSQSISSWLSWYQKKPGQRPKLLIYRASTLASGVSSRFKGSGSGTEFTLTISGVECADAATYYCQQAYSVSNVDNAFGGGTEVVVKR

SEQ ID NO: 14087 - protein, 111 aa, Artificial Sequence
  Description of Artificial Sequence: Synthetic polypeptide
  Humanized antibody sequence
DYQMTQSPSTLSASVGDRVTITCQVSQSISSWLSWYQQKPGKAPKLLIYRASTLASGVPSRFSGSGSGTEFTLTISSLQPDDFATYYCQQAYSVSNVDNAFGGGTKVEIKR

SEQ ID NO: 14088 - protein, 111 aa, Artificial Sequence
  Description of Artificial Sequence: Synthetic polypeptide
  Humanized antibody sequence
AYDMTQTPASVEVAVGGTVTIKCQASESIESYLAWYQQKSGQPPKLLIYRASTLASGVSSRFKGSGSGTQFTLTISGVECADAATYYCQQGDAWSNVDNVFGGGTEVVVKR

SEQ ID NO: 14089 - protein, 111 aa, Artificial Sequence
  Description of Artificial Sequence: Synthetic polypeptide
  Humanized antibody sequence
AYDMTQTPASVEVAVGGTVTIKCQASESISSYLAWYQQKSGQPPKLLIYRASTLASGVSSRFKGSGSGTQFTLTISGVECADAATYYCQQGDAWSNVDNVFGGGTEVVVKR

SEQ ID NO: 14090 - protein, 113 aa, Artificial Sequence
  Description of Artificial Sequence: Synthetic polypeptide
  Humanized antibody sequence
QVLTQTPSPVSAAVGGTVTINCQGSQSLYNNNAFSWYQQKPGQPPKLLIYDASTLASGVPSRFKGSGSGTQFTLTISGVQCADAATYYCQGEFSCGDVDCIAFGGGTEVVVKR

SEQ ID NO: 14091 - protein, 113 aa, Artificial Sequence
  Description of Artificial Sequence: Synthetic polypeptide
  Humanized antibody sequence
QVLTQTPSPVSAAVGGTVTINCQASQSFYNNGAFSWYQQKPGQPPKLLIYDASTLASGVPSRFKGSGSGTQFTLTISGVQCGDAATYYCQGEFSCGSADCVAFGGGTEVVVKR

SEQ ID NO: 14092 - protein, 111 aa, Artificial Sequence
  Description of Artificial Sequence: Synthetic polypeptide
  Humanized antibody sequence
AYDMTQTPASVEVAVGGTVTIKCQASQSISTALAWYQQKPGQRPKLLIYDASKLASGVSSRFKGSGSGAQFTLTISGVECADAATYYCHQGYSSSNVDNTFGGGTEVVVKR

SEQ ID NO: 14093 - protein, 111 aa, Artificial Sequence
  Description of Artificial Sequence: Synthetic polypeptide
  Humanized antibody sequence
DVVMTQTPASVSEPVGGTVTIKCQASQSIDNYLAWYQQKPGQRPRLLIYYTSTLASGVPSRFKGSGSGTEYTLTISDLECADAATYYCQFTAYYSTYIGAFGGGTEVVVKR

SEQ ID NO: 14094 - protein, 111 aa, Artificial Sequence
  Description of Artificial Sequence: Synthetic polypeptide
  Humanized antibody sequence
DIQMTQSPSSLSASVGDRVTITCQASQSIDNYLAWYQQKPGKVPKLLIYYTSTLASGVPSRFSGSGSGTDFTLTISSLQPEDVATYYCQFTAYYSTYIGAFGGGTKVEIKR

SEQ ID NO: 14095 - protein, 111 aa, Artificial Sequence
  Description of Artificial Sequence: Synthetic polypeptide
  Humanized antibody sequence
AYDMTQTPASVEVAVGGTVTIKCQASESISSYLNWYQQKLGQPPKLLIYRASTLTSGVSSRFKGSGSGTEYTLTISDLECADAATYYCQQTYGYSDTDNSFGGGTEVVVKR

SEQ ID NO: 14096 - protein, 111 aa, Artificial Sequence
  Description of Artificial Sequence: Synthetic polypeptide
  Humanized antibody sequence
AYDMTQTPASVEVAVGGTVTIKCQASESISTYLAWYQQKPGQPPKLLIYRASTLASGVSSRFKGSGSGTQFTLTISGVECADAATYYCQQGYSYSNVDNAFGGGTEVVVKR

SEQ ID NO: 14097 - protein, 111 aa, Artificial Sequence
  Description of Artificial Sequence: Synthetic polypeptide
  Humanized antibody sequence
DIQMTQSPSSLSASVGDRVTITCQASESISTYLAWYQQKPGKVPKLLIYRASTLASGVPSRFSGSGSGTDFTLTISSLQPEDVATYYCQQGYSYSNVDNAFGGGTKVEIKR

SEQ ID NO: 14098 - protein, 110 aa, Artificial Sequence
  Description of Artificial Sequence: Synthetic polypeptide
  Humanized antibody sequence
QVLTQTASSVSAAVGGTVTISCQSSQSVTNNNDLAWYQQKPGQPPKLLIYQASKLASGVPSRFKGSGSGTQFTLTISDLECDDAATYYCQGSYSGGICAFGGGTEVVVKR

SEQ ID NO: 14099 - protein, 110 aa, Artificial Sequence
  Description of Artificial Sequence: Synthetic polypeptide
  Humanized antibody sequence
ADVVMTQTPASVSEPVGGTVTIKCQASQSISSYLSWYQQKPGQPPKLLIYGASKLTSGVPSRFKGSGSGTEYTLTISDLECADAATYYCQSNYDIYSYAFGGGTEVVVKR

SEQ ID NO: 14100 - protein, 112 aa, Artificial Sequence
  Description of Artificial Sequence: Synthetic polypeptide
  Humanized antibody sequence
ADIVMTQNPASVSEPVGGTVTIKCQASQSVNSWLSWYQQKPGQPPKFLIYKASTLASGVSSRFKGSGIGTEFTLTISDLECADAATYYCQFSNSGTIYGSGFGGGTEVVVKR

SEQ ID NO: 14101 - protein, 111 aa, Artificial Sequence
  Description of Artificial Sequence: Synthetic polypeptide
  Humanized antibody sequence
DIQMTQSPSTLSASVGDRVTITCQASQSISSWLAWYQQKPGKAPKLLIYEASKLASGVPSRFSGSGSGTEFTLTISSLQPDDFATYYCQQAYSVANVDNAFGGGTKVEIKR

SEQ ID NO: 14102 - protein, 112 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRLEAEDLGVYYCFQGSHVPFTFGGGTKLEIK

SEQ ID NO: 14103 - protein, 112 aa, Artificial Sequence
  Description of Artificial Sequence: Synthetic polypeptide
DLVMTQTPLSLPVSLGDQASISCRSSQSLVHSSGVTYLHWYLQKPGQSPKLLIYKVSNRFSGVPDRFSGSGSGTDFTLKISRVEAEDLGVYFCSQSTHVPPTFGSGTKLEIK

SEQ ID NO: 14104 - protein, 112 aa, Artificial Sequence
  Description of Artificial Sequence: Synthetic polypeptide
DVVMTQSPLSLPVTLGQPASISCRSSQSIVHSNGNTYLEWFQQRPGQSPRRLIYKVSNRFSGVPDRFSGSGSGTDFTLKISRVEAEDVGVYYCFQGSHVPFTFGGGTKVEIK

SEQ ID NO: 14105 - protein, 112 aa, Artificial Sequence
  Description of Artificial Sequence: Synthetic polypeptide
DIVMTQTPLSLSVTPGQPASISCKSSQSLVHSSGVTYLYWYLQKPGQSPQLLIYKVSNRFSGVPDRFSGSGSGTDFTLKISRVEAEDVGVYYCSQSTHVPPTFGQGTKLEIK

SEQ ID NO: 14106 - protein, 112 aa, Artificial Sequence
  Description of Artificial Sequence: Synthetic polypeptide
DIVMTQAASSNPVTLGTSASISCRSSKSLRHTKGITFLYWYLQKPGQSPQLLIYQMSNLASGVPDRFSSSGSGTDFTLRISRVEAEDLGVYYCAQNLELPLTFGAGTKLELK

SEQ ID NO: 14107 - protein, 112 aa, Artificial Sequence
  Description of Artificial Sequence: Synthetic polypeptide
DVVLTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPQTFGGGTKLEIK

SEQ ID NO: 14108 - protein, 112 aa, Artificial Sequence
  Description of Artificial Sequence: Synthetic polypeptide
DVVMTQTPLTLSVTIGRPASISCKSSQSLLDSDGKTYLYWLLQRPGQSPKRLIYLVSELDSGVPDRITGSGSGTDFTLKISRVEAEDLGVYYCWQGTHSPYTFGGGTKLEIK

SEQ ID NO: 14109 - protein, 115 aa, Artificial Sequence
  Description of Artificial Sequence: Synthetic polypeptide
QLALTQSSSASFSLGASAKLTCTLSSQHRTYTIEWYQQQSLKPPKYVMEVKKDGSHSTGHGIPDRFSGSSSGADRYLSISNIQPEDEAIYICGVGDAIKGQSVFVFGGGTKVTVL

SEQ ID NO: 14110 - protein, 112 aa, Artificial Sequence
  Description of Artificial Sequence: Synthetic polypeptide
DIVMTQSPLSLPVTPGEPASISCRSSKSLRHTKGITFLYWYLQKPGQSPQLLIYQMSNRASGVPDRFSGSGSGTDFTLKISRVEAEDVGVYYCAQNLELPLTFGGGTKVEIK

SEQ ID NO: 14111 - protein, 112 aa, Artificial Sequence
  Description of Artificial Sequence: Synthetic polypeptide
DIVMTQSPLSLPVTPGEPASISCRSSKSLRHTKGITFLDWYLQKPGQSPQLLIYQMSNRASGVPDRFSGSGSGTDFTLKISRVEAEDVGVYYCAQNLELPLTFGGGTKVEIK

SEQ ID NO: 14112 - protein, 114 aa, Artificial Sequence
  Description of Artificial Sequence: Synthetic polypeptide
EVQLVESGGGLVQPGGSLRLSCAASGFIFSSYGMSWVRQAPGKGLEWVANINTFGDRTYYVDSVKGRFTISRDNAKNSLYLQMNSLRAEDTAVYYCARGTGTYWGQGTLVTVSS

SEQ ID NO: 14113 - protein, 114 aa, Artificial Sequence
  Description of Artificial Sequence: Synthetic polypeptide
EVQLVESGGGLVQPGGSLRLSCAASGFIFSSYGMSWVRQAPGKGLEWVASINTFGDRTYYVDSVKGRFTISRDNAKNSLYLQMNSLRAEDTAVYYCARGTGTYWGQGTLVTVSS

SEQ ID NO: 14114 - protein, 117 aa, Artificial Sequence
  Description of Artificial Sequence: Synthetic polypeptide
QVQLVQSGAEVKKPGASVKVSCKASGYTFTSYYMYWVRQAPGQGLEWMGIINPSNGGTSYAQKFQGRVTMTRDTSTSTVYMELSSLRSEDTAVYYCTRGGYYPFDYWGQGTTVTVSS

SEQ ID NO: 14115 - protein, 117 aa, Artificial Sequence
  Description of Artificial Sequence: Synthetic polypeptide
QVQLVQSGAEVKKPGASVKVSCKASGYTFTSYYMHWVRQAPGQGLEWMGIINPSNGGTSYAQKFQGRVTMTRDTSTSTVYMELSSLRSEDTAVYYCTRGGYYPFDYWGQGTTVTVSS

SEQ ID NO: 14116 - protein, 117 aa, Artificial Sequence
  Description of Artificial Sequence: Synthetic polypeptide
QVQLVQSGAEVKKPGASVKVSCKASGYTFTSYYMYWVRQAPGQGLEWMGEINPSNGGTNYAQKFQGRVTMTRDTSTSTVYMELSSLRSEDTAVYYCTRGGYYPFDYWGQGTTVTVSS

SEQ ID NO: 14117 - protein, 121 aa, Artificial Sequence
  Description of Artificial Sequence: Synthetic polypeptide
QVQLQESGPGLVKPSQTLSLTCTVSGYSITSDYAWNWIRQHPGKGLEWIGYISFSGYTYYNPSLKSRVTISVDTSKNQFSLKLSSVTAADTAVYYCAREVNYGDSYHFDYWGQGTLVTVSS

SEQ ID NO: 14118 - protein, 121 aa, Artificial Sequence
  Description of Artificial Sequence: Synthetic polypeptide
QVQLQESGPGLVKPSQTLSLTCTVSGYSITSDYAWSWIRQHPGKGLEWIGYISFSGYTYYNPSLKSRVTISVDTSKNQFSLKLSSVTAADTAVYYCAREVNYGDSYHFDYWGQGTLVTVSS

SEQ ID NO: 14119 - protein, 121 aa, Artificial Sequence
  Description of Artificial Sequence: Synthetic polypeptide
QVQLQESGPGLVKPSQTLSLTCTVSGYSITSDYAWNWIRQHPGKGLEWIGYISFSGYTSYNPSLKSRVTISVDTSKNQFSLKLSSVTAADTAVYYCAREVNYGDSYHFDYWGQGTLVTVSS

SEQ ID NO: 14120 - protein, 128 aa, Rattus norvegicus
MDFQVQSFSLLLISITVIVSSGEIVLTQSPTTMAASPGEKVTITCRASSSVSYMHWFQQKSGTSPKPWIYGTSKLASGVPDRFSGSGSGTSYSLTISSMEAEDAATYYCLQRSSYPPTFGAGTKLELK

SEQ ID NO: 14121 - protein, 106 aa, Artificial Sequence
  Description of Artificial Sequence: Synthetic polypeptide
DIVMTQSPDSLAVSLGERATITCRASSSVSYMHWFQQKPGQSPKPWIYGTSKLASGVPDRFSGSGSGTSYSLTISSLQAEDAATYYCLQRSSYPPTFGQGTKVEIK

SEQ ID NO: 14122 - protein, 106 aa, Artificial Sequence
  Description of Artificial Sequence: Synthetic polypeptide
DIVMTQSPDSLAVSLGERATINCRASSSVSYMHWYQQKPGQSPKPLIYGTSKLASGVPDRFSGSGSGTSYSLTISSLQAEDVAVYYCLQRSSYPPTFGQGTKVEIK

SEQ ID NO: 14123 - protein, 106 aa, Artificial Sequence
  Description of Artificial Sequence: Synthetic polypeptide
DIVMTQSPDSLAVSLGERATINCRASSSVSYMHWYQQKPGQSPKPWIYGTSKLASGVPDRFSGSGSGTSYSLTISSLQAEDVAVYYCLQRSSYPPTFGQGTKVEIK

SEQ ID NO: 14124 - protein, 106 aa, Artificial Sequence
  Description of Artificial Sequence: Synthetic polypeptide
DIQMTQSPSSLSASVGDRVTITCRASSSVSYMHWYQQKPGKAPKLLIYGTSKLASGVPSRFSGSGSGTDFTLTISSLQPEDFATYYCLQRSSYPPTFGQGTKVEIK

SEQ ID NO: 14125 - protein, 107 aa, Homo sapiens
DIELTQPPSVSVAPGQTARISCSGDNIPLKYVSWYQQKPGQAPVLVIHDDNKRPSGIPERFSGSNSGNTATLTISGTQAEDEADYYCQSWASTGVVFGGGTKLTVLG

SEQ ID NO: 14126 - protein, 105 aa, Homo sapiens
DIVLTQPPSVSGAPGQRVTISCTGSSSNIGTYDVHWYQQLPGTAPKLLIYSNSKRPSGVPDRFSGSKSGTSASLAITGLQSEDEADYYCSITRVFGGGTKLTVLG

SEQ ID NO: 14127 - protein, 113 aa, Artificial Sequence
  Description of Artificial Sequence: Synthetic polypeptide
DVLMTQTPLSLPVSLGDPASISCRSSQSIVHSNVNTYLEWYLQKPGQSPKLLIYKVSNRFSGVPDRFSGSGAGTDFTLRISRVEAEDLGIYYCFQGSHVPPTFGGGTKLEIKR

SEQ ID NO: 14128 - protein, 113 aa, Artificial Sequence
  Description of Artificial Sequence: Synthetic polypeptide
DVLMTQTPLSLPVSLGDPASISCRSSQSIVHSNVNTYLEWYLQKPGQSPRLLIYKVSNRFSGVPDRFSGSGAGTDFTLRISRVEAEDLGIYYCFQGSHVPPTFGGGTKLEIKR

SEQ ID NO: 14129 - protein, 113 aa, Artificial Sequence
  Description of Artificial Sequence: Synthetic polypeptide
DVVMTQTPLSLPVSLGDPASISCRSSQSIVHSNVNTYLEWYLQKPGQSPKLLIYKVSNRFSGVPDRFSGSGAGTDFTLRISRVEAEDLGIYYCFQGSHVPPTFGGGTKLEIKR

SEQ ID NO: 14130 - protein, 113 aa, Mus musculus; identical to SEQ ID NO: 12796

SEQ ID NO: 14131 - protein, 113 aa, Artificial Sequence
  Description of Artificial Sequence: Synthetic polypeptide
DVVMTQTPLSLPVSLGDPASISCRSSQSIVHSNVNTYLEWYLQKPGQSPRLLIYKVSNRFSGVPDRFSGSGAGTDFTLRISRVEAEDLGIYYCFQGSHVPPTFGGGTKLEIKR

SEQ ID NO: 14132 - protein, 110 aa, Homo sapiens
  MOD_RES (104)..(104): Any amino acid
QSVLTQPPSVSKGLRQTATLTCTGNSNNVGNQGAAWLQQHQGHPPKLLSYRNNNRPSGISERFSASRSGNTASLTITGLQPEDEADYYCSAWDSSLSAWVFGGXTQLTVL

SEQ ID NO: 14133 - protein, 110 aa, Homo sapiens
QSVLTQPASVSGSPGQSITISCTGNNRDVGGYNYVSWFQQYPGKAPKLLIYDVSHRPSGVSNRFSGSKAGNTASLTISGLQAEDEADYYCSSYTSSSTLVFGGGTKLTVL

SEQ ID NO: 14134 - protein, 111 aa, Homo sapiens
  MOD_RES (105)..(105): Any amino acid
QSVLTQPASVSGSPGQSITISCTGTSSDVGGYNLVSWYQQHPGKAPKLMIFEVSQRPSGVSDRFSGSKSGNTASLTVSGLQADDEANYYCQSYDSSVNGWIFGGXTKLTVL

SEQ ID NO: 14135 - protein, 110 aa, Homo sapiens
QAGLTQPASVSGSPGQSITISCTGTSSDVGGYNYVSWYQQHPGKAPKLMIYDVSNRPSGVSNRFSGSKSGNTASLTISGLQAEDEADYYCSSYTSSSTGVFGGGTKLTVL

SEQ ID NO: 14136 - protein, 110 aa, Homo sapiens
QAGLTQPASVSGSPGQSITISCTGTSSDVGGYNYVSWYQQHPGKAPKLMIYDVSNRPSGVSNRFSGSKSGNTASLTISGLQAEDEADYYCSSYTSSNTLVFGGGTKLTVL

SEQ ID NO: 14137 - protein, 110 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCSSYTSRSTYVFGTGTKVTVL

SEQ ID NO: 14138 - protein, 109 aa, Homo sapiens
QSALTQPPSVSAAPGQKVTISCSGSSSNIGNNYVSWYQQLPGTAPKLLIYDNNERPSGISNRFSGSKSGNTASLTISGLQAEDEADYYCSSYTSSSTYVFGTGTKVTVL

SEQ ID NO: 14139 - protein, 108 aa, Homo sapiens
SETTLTQSPAFLSATPGDKVNISCKASQDIDDDVNWYQRKPGEAAIFIIDEASNLVPGVSPRFSGSGYGTDFTLTINNVESEDAAYYFCLQHDHVPITFGQGTRLEIK

SEQ ID NO: 14140 - protein, 110 aa, Homo sapiens
QSVVTQPPSVSAAPGQKVTISCAGSTSNIGNNFVSWYQQLPGTAPKLLIYDNNKRPSEIPDRFSGSKSGTSATLGITGLQTGDEADYYCVTWDSSLSVVLFGGGTKVTVL

SEQ ID NO: 14141 - protein, 106 aa, Homo sapiens
SYELMQPSSVSVSPGQTARITCSGDLLTRRYARWFQQKPGQAPLLIIYRDTVRPSGIPERFSASSSGATITLTISGAQLEDEADYYCYSATDNNVVFGGGTKLTVL

SEQ ID NO: 14142 - protein, 110 aa, Homo sapiens
QPVLTQPPSVSAAPGQKVTISCSGGTSNVANNYVSWYQQLPGTAPKLLIYGNSNRPSGVPDRFSGSKSGTSASLAITGLQAEDEADYYCQSYDTSLSGYVFGSGTKVTVL

SEQ ID NO: 14143 - protein, 107 aa, Homo sapiens
VIWMTQSPSSLSASVGDRVTFTCQASQHISKYLNWYQQKPGKAPKLLIYDASNLETGVPSRFSGSGSATDFTLTISSLQPEDFATYYCQQSYLTSYTFGQGTKVDIK

SEQ ID NO: 14144 - protein, 107 aa, Homo sapiens
DIVMTQSPSSLSASVGDRVTITCRASQSISTYLNWFQQKPGKAPRLLIYAASNLQSGVPSRFSGGGSGTDFTLTINSLQPEDFATYYCQQSYSTPFTFGPGTKVDIK

SEQ ID NO: 14145 - protein, 111 aa, Homo sapiens
LPVLTQPASVSGSPGQSITISCTGTSIDVASYNLVSWYQQHPGKAPKLMIYDVSNRPSGVSTRFSGSKSGNTASLTISGLQAEDEADYYCISRANSNTLYVFGTGTKVTVL

SEQ ID NO: 14146 - protein, 107 aa, Homo sapiens
VIWMTQSPSSLSASVGDRVTITCRATQSISTYLNWYQQKPGKAPNLLIYAASSLQSGVPSRFSGSGSGTDFTLTISSLQPEDFATYYCQQSYRTPGTFGQGTKVDIK

SEQ ID NO: 14147 - protein, 139 aa, Homo sapiens
QPVLTQPPSVSAAPGQKVTISCSGSSSNIGNVLTQPASVSGSPGQSITISCTGNNRDVGGYNYVSWFQQYPGKAPKLLIYDVSHRPSGVSNRFSGSKAGNTASLTISGLQAEDEADYYCSSYTSSSTLVFGGGTKLTVL

SEQ ID NO: 14148 - protein, 112 aa, Artificial Sequence
  Description of Artificial Sequence: Synthetic polypeptide
DVVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIK

SEQ ID NO: 14149 - protein, 108 aa, Homo sapiens
DIQMTQSPSSVSASVGDSVTITCRASQGISSYLAWYQQKPGKAPKLLIYAASSLQSGVPSRFSGNGSGTDFTLTISSLQPEDFATYYCQQANNFPFTFGPGTKVDIKR

SEQ ID NO: 14150 - protein, 112 aa, Homo sapiens; identical to SEQ ID NO: 8058

SEQ ID NO: 14151 - protein, 112 aa, Homo sapiens
QSVLTQAPSVSGAPGQRVTISCTGRSSNIGAGYDVHWYQQFPGTAPKLLIYGNSNRPSGVPDRFSGSKSGTSASLAITGLQAEDEADYYCQSYDSSLSGSVFGGGTKLTVLG

SEQ ID NO: 14152 - protein, 112 aa, Homo sapiens
QSVLTQPPSVSGAPGQRVTISCTGSSSNIGAGYDVHWYQQLPGTAPKLLIYGNNNRPSGVPDRFSGSKSGTSASLAITGLQADDEADYYCQSFDSSLSGSVFGGGTKLTVLG

SEQ ID NO: 14153 - protein, 108 aa, Homo sapiens
DIQMTQSPSSVSASVGDRVTITCRASRGISSWLAWYQQRPGKAPKLLIYTASSLQSGVPSRFSGSGSGTDFTLTISSLQPEDFATYYCQQANSFPFTFGPGTKVDIKR

SEQ ID NO: 14154 - protein, 139 aa, Homo sapiens
MRVPAQLLGLLLLWFPGSRCDIQMTQSPSSVSASVGDSVTITCRASQGISSYLAWYQQKPGKAPKLLIYAASSLQSGVPSRFSGNGSGTDFTLTISSLQPEDFATYYCQQANNFPFTFGPGTKVDIKRTVAAPSVFIFP

SEQ ID NO: 14155 - protein, 153 aa, Homo sapiens
MAWSPLLLTLLIHCTGSWAQSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLGQPKAAPSVTLFPPSSEELQANK

SEQ ID NO: 14156 - protein, 144 aa, Homo sapiens
PLLLTLLAHCTGSWAQSVLTQAPSVSGAPGQRVTISCTGRSSNIGAGYDVHWYQQFPGTAPKLLIYGNSNRPSGVPDRFSGSKSGTSASLAITGLQAEDEADYYCQSYDSSLSGSVFGGGTKLTVLGQPKAAPSVTLFPPSSEE

SEQ ID NO: 14157 - protein, 145 aa, Homo sapiens
PLLLTLLAHCTGSWAQSVLTQPPSVSGAPGQRVTISCTGSSSNIGAGYDVHWYQQLPGTAPKLLIYGNNNRPSGVPDRFSGSKSGTSASLAITGLQADDEADYYCQSFDSSLSGSVFGGGTKLTVLGQPKAAPSVTLFPPSSEEL

SEQ ID NO: 14158 - protein, 177 aa, Homo sapiens
MRVPAQLLGLLLLWFPGSRCDIQMTQSPSSVSASVGDRVTITCRASRGISSWLAWYQQRPGKAPKLLIYTASSLQSGVPSRFSGSGSGTDFTLTISSLQPEDFATYYCQQANSFPFTFGPGTKVDIKRTVAAPSVFIFPPSDEQLKSGTASVVCLLNNFYPREAKVQWKVDNALQSG

SEQ ID NO: 14159 - protein, 122 aa, Mus musculus
LMFWIPASRSDVLMTQIPLSLPVSLGDQASISCRSSQSIVHSNGNTYLQWYLQKPGQSPKLLIYKVSNRLYGVPDRFSGSGSGTDFTLKISSVEAEDLGVYYCFQGSHVPWTFGGGTKLEIK

SEQ ID NO: 14160 - protein, 112 aa, Mus musculus
DVLMTQIPLSLPVSLGDQASISCRSSQSIVHSNGNTYLQWYLQKPGQSPKLLIYKVSNRLYGVPDRFSGSGSGTDFTLKISSVEAEDLGVYYCFQGSHVPWTFGGGTKLEIK

SEQ ID NO: 14161 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPQTFGQGTKVEIK

SEQ ID NO: 14162 - protein, 112 aa, Homo sapiens; identical to SEQ ID NO: 14148

SEQ ID NO: 14163 - protein, 131 aa, Homo sapiens
MKLPVRLLVLMFWFPASSSDVVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIK

SEQ ID NO: 14164 - protein, 131 aa, Homo sapiens
MKLPVRLLVLMFWFPASSSDIVMTQSPLSLPVTPGEPASISCRSSQSIVHSNGNTYLQWYLQKPGQSPQLLIYKVSNRLYGVPDRFSGSGSGTDFTLKISRVEAEDVGVYYCFQGSHVPWTFGQGTKVEIK

SEQ ID NO: 14165 - protein, 123 aa, Mus musculus
DIVMTQSQKFMSTSVGDRVSVTCKASQNVGTNVAWYQQKPGQSPKALIYSSSYRYSGVPDRFTGSGSGTDFTLTISHVQSEDLADYFCQQYNIYPLTFGPGTKLELKRADAAPPTVSIFPPFE

SEQ ID NO: 14166 - protein, 131 aa, Mus musculus
DIVMTQTPLSLPVSLGDQASISCRSSQSLVHGIGNTYLHWYLQKPGQSPKLLIYKVSNRFSGVPDRFSGSGSGTDFTLRISRVEAEDLGLYFCSQSTHVPLTFGAGTKLELKRADAAPTVSIFPPSSEQLK

SEQ ID NO: 14167 - protein, 242 aa, Artificial Sequence
  Description of Artificial Sequence: Synthetic polypeptide
  recombinant immunoglobulin
MKKNIAFLLASMFVFSIATNAYADIVMTQTPLSLPVSLGDQASISCRSSQSLVHGIGNTYLHWYLQKPGQSPKLLIYKVSNRFSGVPDRFSGSGSGTDFTLRISRVEAEDLGLYFCSQSTHVPLTFGAGTKLELKRAVAAPTVFIFPPSSEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14168 - protein, 114 aa, Mus musculus
DIVMTQTPLSLPVSLGDQASISCRSSQSLVHGIGNTYLHWYLQKPGQSPKLLIYYKVSNRFSGVPDRFSDSGSGTDFTLRISRVEAEDLGLYFCSQSTHVPLTFGAGTKLELKR

SEQ ID NO: 14169 - protein, 114 aa, Artificial Sequence
  Description of Artificial Sequence: Synthetic polypeptide
  recombinant immunoglobulin
DIQMTQSPSSLSASVGDRVTITCRSSQSLVHGIGNTYLHWYQQKPGKAPKLLIYYKVSNRFSGVPSRFSGSGSGTDFTLTISSLQPEDFATYYCSQSTHVPLTFGQGTKVEIKR

SEQ ID NO: 14170 - protein, 107 aa, Homo sapiens
DIQMTQSPSSLSASVGDRVTITCRASQGISNYLAWYQQKPGKVPKLLIYAASTLQSGVPSRFSGSGSGTDFTLTISSLQPEDVATYYCQKYNSALLTFGGGTKVEIK

SEQ ID NO: 14171 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQFNTYPITFGPGTKVDIK

SEQ ID NO: 14172 - protein, 106 aa, Homo sapiens
QSELTQTPSVSVSPGQTASITCSGDKLGDKYVSWFQLKPGQSPLLVIYQDSKWPSGIPERFSGSNSGNTATLTISGTQATDEADYYCQVWDISHVVFGGGTKLTVL

SEQ ID NO: 14173 - protein, 107 aa, Homo sapiens
DIQMTQSPSSLSASIGDRVTITCQASQDTDNRLHWYQQKSGRAPKLLIYDAVNLKRGVPSRFRGSGSGTNFILTITNLQPEDMATYFCQHSDGLSLAFGGGTKLEIK

SEQ ID NO: 14174 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTSWTFGQGTKVEIK

SEQ ID NO: 14175 - protein, 110 aa, Homo sapiens
QYELTQPPSVSGTPGQRVTISCSGSSSNIGSEYVYWFQQLPGTAPRLLIYRNDQRPSGVPDRFSGSKSGTSASLAISGLRSEDETDYYCTTWDDSLSGPVFGGGTKLTVL

SEQ ID NO: 14176 - protein, 110 aa, Homo sapiens
QSALTQPPSASGTPGQRVTISCSGSSSNIGRNTVNWYQQLPGTAPKLLIYSNNQRPSGVPDRFAGSKSGTSASLAISGLQSEDEADYYCAAWDDSLNAWVFGGGTKLTAL

SEQ ID NO: 14177 - protein, 108 aa, Homo sapiens
DIQMTQSPGTLSLSPGERATLSCRASQSVDSSYLSWYQQKPGQAPRLLIYGASTRATGIPARFSGSGSGTDFTLTVSRLEPEDFAVYYCQQHGYSSRTFGQGTKVEIK

SEQ ID NO: 14178 - protein, 107 aa, Homo sapiens
DIQMTQSPGTLSLSPGERSTLSCRASQSVSSSYLAWYQQKPGQAPRLLIYGASSRATGIPDRFSGSGSGTDFTLTISRLEPEDFGVYYCHQYGRPPVFGPGTKVDIK

SEQ ID NO: 14179 - protein, 115 aa, Artificial Sequence
  Description of Artificial Sequence: Synthetic polypeptide
  Synthetic Construct
DIVMTQSPSSLTVTAGEKVTMSCKSSQSLLNSGNQKNYLTWYQQKPGQPPKLLIYWTSTRDSGVPDRFTGSGSGTDFTLTISSVQAEDLAVYYCQNDYSYPPTFGGGTKLEIKRA

SEQ ID NO: 14180 - protein, 109 aa, Artificial Sequence
  Description of Artificial Sequence: Synthetic polypeptide
  Synthetic Construct
QAVVTQESALTTSPGETVTLTCRSSTGAVTSTNYANWVQEKPDHLFTGLIGGTNNRAPGVPARFSGSLIGDKAALTITGAQTEDEAIYFCALWYSNHWVFGGGTKLTVL

SEQ ID NO: 14181 - protein, 109 aa, Artificial Sequence
  Description of Artificial Sequence: Synthetic polypeptide
  Synthetic Construct
QAVVTQESALTTSPGETVTLTCRSSTGAVTASNYANWVQEKPDHSFTGLIGGINNRAPGVPARFSGSLIGDKAALTITGAQTEDEAIYFCALWYNNHWVFGGGTKLTVL

SEQ ID NO: 14182 - protein, 112 aa, Artificial Sequence [sequence omitted]

SEQ ID NO: 14183 - protein, 109 aa, Artificial Sequence
  Description of Artificial Sequence: Synthetic polypeptide
  Synthetic Fab-13 VL protein sequence
DIQMTQSPSSLSASVGDRVTITCRASQTISHYLAWYQQKPGKAPKLLIYAASILQSGVPSRFSGSGSGTDFTLTISSLQPEDFAVYYCQQYSGFPVTFGQGTKVEIKRT

SEQ ID NO: 14184 - protein, 108 aa, Artificial Sequence
  Description of Artificial Sequence: Synthetic polypeptide
  Synthetic Fab-28 VL protein sequence
DIELTQPPSVSVAPGQSITISCSGDNLGDKYVHWYQQKPGQAPVLVIYDDNERPSGIPERFSGSNSGNTATLTISGTQAEDEADYYCSAYGSHSGTVFGGGTKLTVLG

SEQ ID NO: 14185 - protein, 1390 aa, Homo sapiens
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 14186 - protein, 510 aa, Artificial Sequence
  Description of Artificial Sequence: Synthetic polypeptide
  B2M-aTacVL
MIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGSHSMRYFFTSVSRPGRGEPRFIAVGYVDDTQFVRFDSDAASQRMEPRAPWIEQEGPEYWDGETRKVKAHSQTHRVDLGTLRGYYNQSEAGSHTVQRMYGCDVGSDWRFLRGYHQYAYDGKDYIALKEDLRSWTAADMAAQTTKHKWEAAHVAEQLRAYLEGTCVEWLRRYLENGKETLQRTDAPKTHMTHHAVSDHEATLRCWALSFYPAEITLTWQRDGEDQTQDTELVETRPAGDGTFQKWAAVVVPSGQEQRYTCHVQHEGLPKPLTLRWEGGGGSGGGGSGGGGSQIVLTQSPAIMSASPGEKVTITCSASSSISYMHWFQQKPGTSPKLWIYTTSNLASGVPARFSGSGSGTSYSLTISRMEAEDAATYYCHQRSTYPLTFGCGTKLEL

SEQ ID NO: 14187 - protein, 109 aa, Artificial Sequence
  Description of Artificial Sequence: Synthetic polypeptide
ETTLTQSPATLSLSPGERATLSCRASQSISSSYLAWYQHKPGQAPRLLIYGASRRATGIPDRFSGSGSGTDFSLTISRLEPEDFAVYYCLHYGSSKWTFGQGTKVEIKR

SEQ ID NO: 14188 - protein, 108 aa, mus sp.
DIVMTQSPAIMSASPGEKVTMTCSASSSVSSSYLYWYQQKPGSSPKLWIYSTSNLASGVPARFSGSGSGTSYSLTISSMEAEDAASYFCHQWNRYPYTFGGGTKLEIK

SEQ ID NO: 14189 - protein, 109 aa, Artificial Sequence
  Description of Artificial Sequence: Synthetic polypeptide
DIQLTQSPAIMSASPGEKVTMTCSASSSVSSSYLYWYQQKPGSSPKLWIYSTSNLASGVPARFSGSGSGTSYSLTISSMEAEDAASYFCHQWNRYPYTFGGGTKLEIKR

SEQ ID NO: 14190 - protein, 107 aa, Homo sapiens
DIQMTQSPSSLSASVGDRVTITCRASQSISNYLSWYQQKPGKAPKLLIYAASSLQSGVTSRFSGSGSGTDFTLTISSLQPEDSATYYCQQSYSTLITFGQGTRLEIK

SEQ ID NO: 14191 - protein, 109 aa, Homo sapiens
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIKR

SEQ ID NO: 14192 - protein, 107 aa, Homo sapiens; identical to SEQ ID NO: 13749

SEQ ID NO: 14193 - protein, 107 aa, Homo sapiens
DIQMTQSPSSVSASVGDRVTITCRASQGISIWLAWYQHKPGKAPKLLIYAASSLQSGVPSRFSGSGSGTDFTLTISSLQPEDFATYYCQQANSFPWTFGQGTKVEIK

SEQ ID NO: 14194 - protein, 108 aa, Homo sapiens
EIVLTQSPGTLSLSPGERATLSCRASQSVSSGFLAWFQQKPGQAPRLLIYGASSRATAIPDRFSGSGSGTDFTLTISRLEPEDFAVYYCQQYGSSPYTFGQGTKLEIK

SEQ ID NO: 14195 - protein, 108 aa, Homo sapiens
EIVLTQSPGTLSLSPGERATLSCRASQSVSSSYLAWYQQKPGQAPRLLIYVASSRATGIPDRFSGSGSGTDFTLTISRLEPEDFAVYYCQQYGSSPYTFGQGTKLEIK

SEQ ID NO: 14196 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSYTFGQGTKLEIK

SEQ ID NO: 14197 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNSYPWTFGQGTKVEIK

SEQ ID NO: 14198 - protein, 108 aa, Homo sapiens
EIVLTQSPGTLSLSPGERATLSCRASQSVSSSYLAWYQQKPGQAPRLLIYGASSRATGIPDRFSGSGSGTGFTLTISSLEPEDFAVYYCQQYNSYPWTFGQGTKVEIK

SEQ ID NO: 14199 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 14200 - protein, 108 aa, Artificial Sequence
  Description of Artificial Sequence: Synthetic polypeptide
EIVLTQSPGTLSLSPGERATLSCRASQSVSNSHLAWYQQQPGQAPRLLIYSASSRATGIPDRFSGSGSGTDFTLTISRLEPEDFAVYYCQQYGSSLYTFGQGTKLEIK

SEQ ID NO: 14201 - protein, 107 aa, Artificial Sequence
  Description of Artificial Sequence: Synthetic polypeptide
EIVLTQSPGTLSLSPGERATLSCRASQSVSRHLAWYQQNSGQAPRLLIYSASSRATGIPDRFSGRGSGTDFTLTISRLEPEEFAVYYCQQYSSSPITFGQGTRLEIN

SEQ ID NO: 14202 - protein, 108 aa, Artificial Sequence
  Description of Artificial Sequence: Synthetic polypeptide
ENVLTQSPGTLSLSPGERGTLSCRASQNISGRSLAWYHQKPGQTPKLLIFGASRRATGIPDRFSGSGSGTDFTLTISRLEPEDFAVYYCQQYGSSPITFGQGTRLEIK

SEQ ID NO: 14203 - protein, 107 aa, Artificial Sequence
  Description of Artificial Sequence: Synthetic polypeptide
EIMLTQSPGTLSLSPGERATLSCRASQSVSSHLAWYQQTSGQAPRLLIYGASSRTTGIPDRFSGSGSGTDFTLTISRLEPEDFAVYYCQHYSKSPITFGQGTRLEIN

SEQ ID NO: 14204 - protein, 107 aa, Artificial Sequence
  Description of Artificial Sequence: Synthetic polypeptide
EIVLTQSPDTLSLSLGERAILSCRASQSVSSYLAWYQQTSGQAPRLLIFGASSRATGIPDRFSGSGSGTDFTLTINRLEPGDFAVYYCQQYASSPITFGQGTRLDIN

SEQ ID NO: 14205 - protein, 107 aa, Artificial Sequence
  Description of Artificial Sequence: Synthetic polypeptide
DIRMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKLEIK

SEQ ID NO: 14206 - protein, 108 aa, Artificial Sequence
  Description of Artificial Sequence: Synthetic polypeptide
DIQMTQSPSSLSASVGDRVTITCRASQAIRNDLGWYQQKPGKAPKRLIYAAFNLQSGVPSRFSGSGSGTEFTLTISSLQPEDFATYYCQQYNRYPWTFGQGTKVEIKR

SEQ ID NO: 14207 - protein, 108 aa, Artificial Sequence
  Description of Artificial Sequence: Synthetic polypeptide
DIQMTQSPSSLSASVGDRVTITCRASQAIRNDLGWYQQKPGKAPKRLIYAAFSLQSGVPSRFSGSGSGTEFTLTISSLQPEDFATYYCQQYNRYPWTFGQGTKVEIKR

SEQ ID NO: 14208 - protein, 108 aa, Artificial Sequence
  Description of Artificial Sequence: Synthetic polypeptide
DIQMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKVEIKR

SEQ ID NO: 14209 - protein, 108 aa, Artificial Sequence
  Description of Artificial Sequence: Synthetic polypeptide
DIQMTQSPSSLSASAGDRVTITCRASQAIRNDLGWYQQKPGKAPKRLIYAAFSLQSGVPSRFSGSGSGTEFTLTISSLQPEDLASYYCQQYNRYPWTFGQGTKVEIKR

SEQ ID NO: 14210 - protein, 107 aa, Artificial Sequence
  Description of Artificial Sequence: Synthetic polypeptide
DIVMTQSPSSLSASVRDRVTITCRASQGIRNDLGWYQQKPGKAPKRLIYAASSLQSGVPSRFSGSGSGTEFTLTLSSLQPEDFATYYCSQYNNYPWTFGQGTKVEIK

SEQ ID NO: 14211 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCSQYNNYPWTFGQGTKVEIK

SEQ ID NO: 14212 - protein, 107 aa, Artificial Sequence
  Description of Artificial Sequence: Synthetic polypeptide
DIQMTQSPSSLSASVRDRVTITCRASQGIRNDLGWYQQKPGKAPKRLIYAASSLQSGVPSRFSGSGSGTEFTLTLSSLQPEDFATYYCSQYNNYPWTFGQGTKVEIK

SEQ ID NO: 14213 - protein, 107 aa, Artificial Sequence
  Description of Artificial Sequence: Synthetic polypeptide
DVVMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKLEIK

SEQ ID NO: 14214 - protein, 107 aa, Artificial Sequence [sequence omitted]

SEQ ID NO: 14215 - protein, 107 aa, Artificial Sequence
  Description of Artificial Sequence: Synthetic polypeptide
DIQMTQSPSSLSASVRDRVTITCRASQGIRNDLGWYQQKPGKAPKRLIYGAFSLQSGVPSRFSGSGSGTEFTLTISSLQPEDFATYYCLQYNTYPWTFGQGTKVEIK

SEQ ID NO: 14216 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGAFSLQSGVPSRFSGSGSGTEFTLTISSLQPEDFATYYCLQYNTYPWTFGQGTKVEIK

SEQ ID NO: 14217 - protein, 107 aa, Artificial Sequence
  Description of Artificial Sequence: Synthetic polypeptide
EIVLTQSPSSLSASVGDRVTITCRASQGIRNDLGWYQQKPGKAPKRLIYAASSLQSGVPSRFSGSGSGTEFTLTISSLQPEDFATYYCLQYNSYPWTFGQGTKLEIK

SEQ ID NO: 14218 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQYNSYPWTFGQGTKVEIK

SEQ ID NO: 14219 - protein, 107 aa, Artificial Sequence
  Description of Artificial Sequence: Synthetic polypeptide
DIRMTQSPATLSVSPGERATLSCRASQSVTYNLDWYQQKPGQAPRLLIFGASTRATGIPARFSGSGSGTEFTLTITSLQSEDFAVYYCQQYNNWPYTFGQGTKVEIK

SEQ ID NO: 14220 - protein, 108 aa, Artificial Sequence
  Description of Artificial Sequence: Synthetic polypeptide
EIVMTQSPATLSVSPGERATLSCRASQSVTYNLDWYQQKPGQAPRLLIYGASTRATGIPARFSGSGSGTEFTLTISSLQSEDFAVYYCQQYNNWPYTFGQGTKLEIKR

SEQ ID NO: 14221 - protein, 108 aa, Artificial Sequence
  Description of Artificial Sequence: Synthetic polypeptide
EIVMTQSPATLSVSPGERATLSCRASQSVTYNLAWYQQKPGQAPRLLIYGASTRATGIPARFSGSGSGTEFTLTISSLQSEDFAVYYCQQYNNWPYTFGQGTKLEIKR

SEQ ID NO: 14222 - protein, 108 aa, Artificial Sequence
  Description of Artificial Sequence: Synthetic polypeptide
EIVMTQSPATLSVSPGERATLSCRASQSVTYNLDWYQQKPGQAPRLLIFGASTRATGIPARFSGSGSGTEFTLTITSLQSEDFAVYYCQQYNNWPYTFGQGTKLEIKR

SEQ ID NO: 14223 - protein, 108 aa, Artificial Sequence
  Description of Artificial Sequence: Synthetic polypeptide
EIVMTQSPATLSVSPGERATLSCRASQSVTYNLAWYQQKPGQAPRLLIFGASTRATGIPARFSGSGSGTEFTLTITSLQSEDFAVYYCQQYNNWPYTFGQGTKLEIKR

SEQ ID NO: 14224 - protein, 107 aa, Artificial Sequence
  Description of Artificial Sequence: Synthetic polypeptide
EIVLTQSPSSLSASVRDRVTITCRASQGIRNDLGWYQQKPGKAPKRLIYAASSLQSGVPSRFSGSGSGTESTLTISSLQPEDFATYYCSQYNSYPWTFGQGTKVEIK

SEQ ID NO: 14225 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCSQYNSYPWTFGQGTKVEIK

SEQ ID NO: 14226 - protein, 107 aa, Artificial Sequence
  Description of Artificial Sequence: Synthetic polypeptide
DIQMTQSPSSLSASVRDRVTITCRASQGIRNDLGWYQQKPGKAPKRLIYAASSLQSGVPSRFSGSGSGTESTLTISSLQPEDFATYYCSQYNSYPWTFGQGTKVEIK

SEQ ID NO: 14227 - protein, 107 aa, Artificial Sequence
  Description of Artificial Sequence: Synthetic polypeptide
AIQLTQSPSSLSASAGDRVTITCRASQAIRNDLGWYQQKPGKAPKRLVYAAFNLQSGVPSRFSGSGSGTEFTLTISSLQPEDLATYYCLQYNSYPWTFGQGTKVDIK

SEQ ID NO: 14228 - protein, 107 aa, Artificial Sequence
  Description of Artificial Sequence: Synthetic polypeptide
DIQMTQSPSSLSASVGDRVTITCRASQAIRNDLGWYQQKPGKAPKRLIYAAFSLQSGVPSRFSGSGSGTEFTLTISSLQPEDFATYYCLQYNSYPWTFGQGTKVEIK

SEQ ID NO: 14229 - protein, 107 aa, Artificial Sequence
  Description of Artificial Sequence: Synthetic polypeptide
DIQMTQSPSSLSASAGDRVTITCRASQAIRNDLGWYQQKPGKAPKRLVYAAFNLQSGVPSRFSGSGSGTEFTLTISSLQPEDLATYYCLQYNSYPWTFGQGTKVEIK

SEQ ID NO: 14230 - protein, 107 aa, Artificial Sequence
  Description of Artificial Sequence: Synthetic polypeptide
DIRMTQSPATLSVSPGERATLSCRASPSVSSNLAWYQQRPGQPPRLLIYGASTRATGIPARFSGSGSGTEFTLTISSLQSEDFAVYYCQQYSNWPYTFGQGTKVEIK

SEQ ID NO: 14231 - protein, 107 aa, Artificial Sequence
  Description of Artificial Sequence: Synthetic polypeptide
EIVMTQSPATLSVSPGERATLSCRASPSVSSNLAWYQQKPGQAPRLLIYGASTRATGIPARFSGSGSGTEFTLTISSLQSEDFAVYYCQQYSNWPYTFGQGTKLEIK

SEQ ID NO: 14232 - protein, 107 aa, Artificial Sequence
  Description of Artificial Sequence: Synthetic polypeptide
EIVMTQSPATLSVSPGERATLSCRASPSVSSNLAWYQQRPGQPPRLLIYGASTRATGIPARFSGSGSGTEFTLTISSLQSEDFAVYYCQQYSNWPYTFGQGTKLEIK

SEQ ID NO: 14233 - protein, 107 aa, Artificial Sequence
  Description of Artificial Sequence: Synthetic polypeptide
AIQLTQSPATLSVSPGERATLSCRASQSVSSNLAWYQQKPDQAPRLLIYGSSTRATGIPARFSGSGSGTEFTLTISSLQSEDFAVYYCQQYNNWPYTFGQGTKVEIK

SEQ ID NO: 14234 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGSSTRATGIPARFSGSGSGTEFTLTISSLQSEDFAVYYCQQYNNWPYTFGQGTKLEIK

SEQ ID NO: 14235 - protein, 107 aa, Artificial Sequence
  Description of Artificial Sequence: Synthetic polypeptide
EIVMTQSPATLSVSPGERATLSCRASQSVSSNLAWYQQKPDQAPRLLIYGSSTRATGIPARFSGSGSGTEFTLTISSLQSEDFAVYYCQQYNNWPYTFGQGTKLEIK

SEQ ID NO: 14236 - protein, 107 aa, Artificial Sequence
  Description of Artificial Sequence: Synthetic polypeptide
DVVMTQSPATLSVSPGERATLSCRASQSVSSNLDWYQQKPGQAPRLLIYGASTRATGIPARFSGSGSGTEFTLTISSLQSEDFAVYYCQQYNNWPYTFGQGTKLEIK

SEQ ID NO: 14237 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQYNNWPYTFGQGTKLEIK

SEQ ID NO: 14238 - protein, 107 aa, Artificial Sequence
  Description of Artificial Sequence: Synthetic polypeptide
EIVMTQSPATLSVSPGERATLSCRASQSVSSNLDWYQQKPGQAPRLLIYGASTRATGIPARFSGSGSGTEFTLTISSLQSEDFAVYYCQQYNNWPYTFGQGTKLEIK

SEQ ID NO: 14239 - protein, 107 aa, Artificial Sequence
  Description of Artificial Sequence: Synthetic polypeptide
EIVLTQSPATLSVSPGERATLSCRASPSVSSNLAWYQQKPGQPPRLLIYGASTRATGIPARFSGSGSGTEFTLTISSLQSEDFAVYYCQQYSNWPYTFGQGTKLEIK

SEQ ID NO: 14240 - protein, 107 aa, Artificial Sequence
  Description of Artificial Sequence: Synthetic polypeptide
EIVMTQSPATLSVSPGERATLSCRASPSVSSNLAWYQQKPGQPPRLLIYGASTRATGIPARFSGSGSGTEFTLTISSLQSEDFAVYYCQQYSNWPYTFGQGTKLEIK

SEQ ID NO: 14241 - protein, 107 aa, Artificial Sequence
  Description of Artificial Sequence: Synthetic polypeptide
EIVMTQSPATLSVSPGERATLSCRASPSVSSNLAWYQQKPGQPPRLLIYGASTRATGIPARFSGSGSGTEFTLTISSLQSEDFAVYYCQQYSNWPYTFGQGTKVEIK

SEQ ID NO: 14242 - protein, 107 aa, Artificial Sequence
  Description of Artificial Sequence: Synthetic polypeptide
DIVMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKLEIK

SEQ ID NO: 14243 - protein, 107 aa, Artificial Sequence
  Description of Artificial Sequence: Synthetic polypeptide
EIVMTQSPATLSVSPGERATLSCRASRTVTYNLDWYQQKPGQAPRLLIFGASTRATGIPARFSGSGSGTEFTLTITSLQSEDFAVYYCQQYNNWPYTFGQGTKLEIK

SEQ ID NO: 14244 - protein, 107 aa, Artificial Sequence
  Description of Artificial Sequence: Synthetic polypeptide
EIVLTQSPATLSASPGDRASLSCRASQSVTFNLDWYQQKPGQPPRLLIYGASTRASGIPARFSGSGSGTEFTLTISGLQSEDFAVYYCQQYNNWPYTFGQGTKVDIK

SEQ ID NO: 14245 - protein, 107 aa, Artificial Sequence
  Description of Artificial Sequence: Synthetic polypeptide
EIVMTQSPATLSVSPGERATLSCRASQSVTFNLAWYQQKPGQPARLLIYGASTRATGIPARFSGSGSGTEFTLTISSLQSEDFAVYYCQQYNNWPYTFGQGTKLEIK

SEQ ID NO: 14246 - protein, 107 aa, Artificial Sequence
  Description of Artificial Sequence: Synthetic polypeptide
EIVMTQSPATLSASPGDRASLSCRASQSVTFNLDWYQQKPGQPPRLLIYGASTRASGIPARFSGSGSGTEFTLTISGLQSEDFAVYYCQQYNNWPYTFGQGTKLEIK

SEQ ID NO: 14247 - protein, 107 aa, Artificial Sequence
  Description of Artificial Sequence: Synthetic polypeptide
EIVMTQSPATLSVSPGERATLSCRASPSVSSNLAWYQQKPGQPPRLLIYGTSTRATGIPARFSGSGSGTEFTLTIRSLQSEDFAVYYCQQYSNWPYTFGQGTKVDIK

SEQ ID NO: 14248 - protein, 107 aa, Artificial Sequence
  Description of Artificial Sequence: Synthetic polypeptide
EIVMTQSPATLSVSPGERATLSCRASPSVSSNLAWYQQKPGQAPRLLIYGTSTRATGIPARFSGSGSGTEFTLTISSLQSEDFAVYYCQQYSNWPYTFGQGTKLEIK

SEQ ID NO: 14249 - protein, 107 aa, Artificial Sequence
  Description of Artificial Sequence: Synthetic polypeptide
EIVMTQSPATLSVSPGERATLSCRASPSVSSNLAWYQQKPGQPPRLLIYGTSTRATGIPARFSGSGSGTEFTLTIRSLQSEDFAVYYCQQYSNWPYTFGQGTKLEIK

SEQ ID NO: 14250 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGVPARFSGSGSGTEFTLTISSLQSEDFAVYYCQHYNYWPYTFGQGTKVDIK

SEQ ID NO: 14251 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQHYNYWPYTFGQGTKLEIK

SEQ ID NO: 14252 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGVPARFSGSGSGTEFTLTISSLQSEDFAVYYCQHYNYWPYTFGQGTKLEIK

SEQ ID NO: 14253 - protein, 107 aa, Artificial Sequence
  Description of Artificial Sequence: Synthetic polypeptide
DIVMTQSPSSLSASVRDRVTITCRASQGIRNELGWYQQKPGKAPKLLIYAASSLQSGVPSRFSGSGSGTDFTLTFSSLQPEDFATYYCSQDNNFPWTFGQGTKVEIK

SEQ ID NO: 14254 - protein, 107 aa, Artificial Sequence
  Description of Artificial Sequence: Synthetic polypeptide
DIQMTQSPSSLSASVGDRVTITCRASQGIRNELGWYQQKPGKAPKRLIYAASSLQSGVPSRFSGSGSGTEFTLTISSLQPEDFATYYCSQDNNFPWTFGQGTKVEIK

SEQ ID NO: 14255 - protein, 107 aa, Artificial Sequence
  Description of Artificial Sequence: Synthetic polypeptide
DIQMTQSPSSLSASVRDRVTITCRASQGIRNELGWYQQKPGKAPKLLIYAASSLQSGVPSRFSGSGSGTDFTLTFSSLQPEDFATYYCSQDNNFPWTFGQGTKVEIK

SEQ ID NO: 14256 - protein, 107 aa, Homo sapiens [sequence omitted]

SEQ ID NO: 14257 - protein, 107 aa, Artificial Sequence
  Description of Artificial Sequence: Synthetic polypeptide
DIMLTQSPPTLSVTPGETISLSCRASQRINTDLHWYQQKPNESPRVLIKFASQTISGVPSRFSGSGSGTDFTLNINRVEPEDFSVYYCQQSNSWPYTFGAGTKLELK

SEQ ID NO: 14258 - protein, 107 aa, Artificial Sequence
  Description of Artificial Sequence: Synthetic polypeptide
DIMLTQSPATLSVTPGERISLSCRASQKISTNLHWYQQKPNESPRILIKYASQTISGIPSRFSGSGSGTDFTLHINTVEPEDFSVYYCQQTNSWPLTFGSGTKLEIK

SEQ ID NO: 14259 - protein, 107 aa, Artificial Sequence
  Description of Artificial Sequence: Synthetic polypeptide
DIILTQSPAALSVTPGESISLSCRASQSINTNLHWYQQKPNESPRVLIKYASQTISGIPSRFSGSGSGTDFTLNINRVEPEDFSVYYCQQSNSWPLTFGSGTKLEIK

SEQ ID NO: 14260 - protein, 107 aa, Artificial Sequence
  Description of Artificial Sequence: Synthetic polypeptide
DIMLTQSPATLSVTPGESISLSCRASQSINTNLHWYQQKPNESPRVLIKYASQTISGIPSRFSGSGSGTDFTLNINRVEPEDFSVYYCQQSNSWPLTFGSGTKLEIK

SEQ ID NO: 14261 - protein, 107 aa, Artificial Sequence
  Description of Artificial Sequence: Synthetic polypeptide
DIMLTQSPVTLSVSPGESISLSCRASQSISTDLHWYQQKPNESPRVLIKYGSQTISGIPSRFSGSGSGTDFTLNINRVEPEDFSVYYCQQSNSWPWTFGGGTKLELK

SEQ ID NO: 14262 - protein, 107 aa, Artificial Sequence
  Description of Artificial Sequence: Synthetic polypeptide
DIQMTQSPSSLSASVGDRVTITCRASQRINTDLHWYQQKPGKAPKLLIYFASQTISGVPSRFSGSGSGTDFTLTISSLQPEDFATYYCQQSNSWPYTFGQGTKLEIK

SEQ ID NO: 14263 - protein, 107 aa, Artificial Sequence
  Description of Artificial Sequence: Synthetic polypeptide
DIQLTQSPSSLSASVGDRVTITCRASQRINTDLHWYQQKPGKAPKVLIKFASQTISGVPSRFSGSGSGTDFTLTISSLQPEDFATYYCQQSNSWPYTFGQGTKLEIK

SEQ ID NO: 14264 - protein, 107 aa, Artificial Sequence
  Description of Artificial Sequence: Synthetic polypeptide
DIQLTQSPSSLSASVGDRVTITCRASQRINTDLHWYQQKPGKAPKLLIYFASQTISGVPSRFSGSGSGTDFTLTISSLQPEDFATYYCQQSNSWPYTFGQGTKLEIK

SEQ ID NO: 14265 - protein, 107 aa, Artificial Sequence
  Description of Artificial Sequence: Synthetic polypeptide
DIQMTQSPSSLSASVGDRVTITCRASQRINTDLHWYQQKPGKAPKVLIYFASQTISGVPSRFSGSGSGTDFTLTISSLQPEDFATYYCQQSNSWPYTFGQGTKLEIK

SEQ ID NO: 14266 - protein, 107 aa, Artificial Sequence
  Description of Artificial Sequence: Synthetic polypeptide
DIQMTQSPSSLSASVGDRVTITCRASQRINTDLHWYQQKPGKAPKLLIKFASQTISGVPSRFSGSGSGTDFTLTISSLQPEDFATYYCQQSNSWPYTFGQGTKLEIK

SEQ ID NO: 14267 - protein, 107 aa, Artificial Sequence
  Description of Artificial Sequence: Synthetic polypeptide
DIQLTQSPSSLSASVGDRVTITCRASQRINTDLHWYQQKPGKAPKVLIYFASQTISGVPSRFSGSGSGTDFTLTISSLQPEDFATYYCQQSNSWPYTFGQGTKLEIK

SEQ ID NO: 14268 - protein, 107 aa, Artificial Sequence
  Description of Artificial Sequence: Synthetic polypeptide
DIQLTQSPSSLSASVGDRVTITCRASQRINTDLHWYQQKPGKAPKLLIKFASQTISGVPSRFSGSGSGTDFTLTISSLQPEDFATYYCQQSNSWPYTFGQGTKLEIK

SEQ ID NO: 14269 - protein, 107 aa, Artificial Sequence
  Description of Artificial Sequence: Synthetic polypeptide
DIQMTQSPSSLSASVGDRVTITCRASQRINTDLHWYQQKPGKAPKVLIKFASQTISGVPSRFSGSGSGTDFTLTISSLQPEDFATYYCQQSNSWPYTFGQGTKLEIK

SEQ ID NO: 14270 - protein, 107 aa, Artificial Sequence
  Description of Artificial Sequence: Synthetic polypeptide
DIMLTQSPSSLSASVGDRVTITCRASQRINTDLHWYQQKPGKAPKVLIKFASQTISGVPSRFSGSGSGTDFTLTISSLQPEDFATYYCQQSNSWPYTFGQGTKLEIK

SEQ ID NO: 14271 - protein, 107 aa, Artificial Sequence
  Description of Artificial Sequence: Synthetic polypeptide
DIQLTQSPSSLSASVGDRVTITCRASQRINTDLHWYQQKPGKAPRVLIKFASQTISGVPSRFSGSGSGTDFTLTISSLQPEDFATYYCQQSNSWPYTFGQGTKLEIK

SEQ ID NO: 14272 - protein, 107 aa, Artificial Sequence
  Description of Artificial Sequence: Synthetic polypeptide
DIQMTQSPSSLSASVGDRVTITCRASQRINTDLHWYQQKPGKAPRVLIKFASQTISGVPSRFSGSGSGTDFTLTISSLQPEDFATYYCQQSNSWPYTFGQGTKLEIK

SEQ ID NO: 14273 - protein, 214 aa, Artificial Sequence
  Description of Artificial Sequence: Synthetic polypeptide
DIQMTQSPSSLSASVGDRVTITCRASQRINTDLHWYQQKPGKAPKVLIKFASQTISGVPSRFSGSGSGTDFTLTISSLQPEDFATYYCQQSNSWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14274 - protein, 107 aa, Artificial Sequence
  Description of Artificial Sequence: Synthetic polypeptide
DIQMTQSPSSLSASVGDRVTITCRASQKISTNLHWYQQKPGKAPKLLIYYASQTISGVPSRFSGSGSGTDFTLTISSLQPEDFATYYCQQTNSWPLTFGGGTKVEIK

SEQ ID NO: 14275 - protein, 107 aa, Artificial Sequence
  Description of Artificial Sequence: Synthetic polypeptide
DIQMTQSPSSLSASVGDRVTITCRASQKISTNLHWYQQKPGKAPKILIKYASQTISGVPSRFSGSGSGTDFTLTISSLQPEDFATYYCQQTNSWPLTFGGGTKVEIK

SEQ ID NO: 14276 - protein, 106 aa, Artificial Sequence
  Description of Artificial Sequence: Synthetic polypeptide
IQLTQSPSSLSASVGDRVTITCRASQKISTNLHWYQQKPGKAPKLLIYYASQTISGVPSRFSGSGSGTDFTLTISSLQPEDFATYYCQQTNSWPLTFGGGTKVEIK

SEQ ID NO: 14277 - protein, 107 aa, Artificial Sequence
  Description of Artificial Sequence: Synthetic polypeptide
DIQMTQSPSSLSASVGDRVTITCRASQKISTNLHWYQQKPGKAPKILIYYASQTISGVPSRFSGSGSGTDFTLTISSLQPEDFATYYCQQTNSWPLTFGGGTKVEIK

SEQ ID NO: 14278 - protein, 107 aa, Artificial Sequence
  Description of Artificial Sequence: Synthetic polypeptide
DIQMTQSPSSLSASVGDRVTITCRASQKISTNLHWYQQKPGKAPKLLIKYASQTISGVPSRFSGSGSGTDFTLTISSLQPEDFATYYCQQTNSWPLTFGGGTKVEIK

SEQ ID NO: 14279 - protein, 107 aa, Artificial Sequence
  Description of Artificial Sequence: Synthetic polypeptide
DIQLTQSPSSLSASVGDRVTITCRASQKISTNLHWYQQKPGKAPKILIYYASQTISGVPSRFSGSGSGTDFTLTISSLQPEDFATYYCQQTNSWPLTFGGGTKVEIK

SEQ ID NO: 14280 - protein, 107 aa, Artificial Sequence
  Description of Artificial Sequence: Synthetic polypeptide
DIQLTQSPSSLSASVGDRVTITCRASQKISTNLHWYQQKPGKAPKLLIKYASQTISGVPSRFSGSGSGTDFTLTISSLQPEDFATYYCQQTNSWPLTFGGGTKVEIK

SEQ ID NO: 14281 - protein, 107 aa, Artificial Sequence
  Description of Artificial Sequence: Synthetic polypeptide
DIQLTQSPSSLSASVGDRVTITCRASQKISTNLHWYQQKPGKAPKILIKYASQTISGVPSRFSGSGSGTDFTLTISSLQPEDFATYYCQQTNSWPLTFGGGTKVEIK

SEQ ID NO: 14282 - protein, 214 aa, Artificial Sequence
  Description of Artificial Sequence: Synthetic polypeptide
DIQMTQSPSSLSASVGDRVTITCRASQKISTNLHWYQQKPGKAPKILIKYASQTISGVPSRFSGSGSGTDFTLTISSLQPEDFATYYCQQTNSWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14283 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGQGTKVEIK

SEQ ID NO: 14284 - protein, 109 aa, Homo sapiens
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLG

SEQ ID NO: 14285 - protein, 109 aa, Homo sapiens
SSELTQDPAVSVALGQTVRITCQGDSLRSYYASWYQQKPGQAPVLVIYGKNNRPSGIPDRFSGSSSGNTASLTITGAQAEDEADYYCNSRDNSDNRLIFGGGTKLTVLS

SEQ ID NO: 14286 - protein, 107 aa, Artificial Sequence
  Description of Artificial Sequence: Synthetic polypeptide
DIVMTQSHKFMSTSVGDRVSITCKASQDVGTAVAWYQQKPGQSPKLLIYWASTRHTGVPDRFTGSGSGTDFTLTISNVQSEDLADYFCQQYNSYPLTFGAGSKLELK

SEQ ID NO: 14287 - protein, 107 aa, Artificial Sequence
  Description of Artificial Sequence: Synthetic polypeptide
DIMMTQSHKFMSTSVGDRVSITCKASQDVGTAVAWYQQKPGQSPKLLIYWASTRHTGVPDRFTGSGSGTDFTLTISNVQSEDLADYFCQQYNSYPLTFGQGTKVEIK

SEQ ID NO: 14288 - protein, 447 aa, Artificial Sequence
  Description of Artificial Sequence: Synthetic polypeptide
QVQLVQSGAEVKKPGASVKVSCKASGYTFTSYWMYWVRQATGQGLEWMGRIDPNSGSTKYNEKFKNRFTISRDDSKNTAYLQMNSLKTEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 14289 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQYGRNPPTFGQGTKLEIK

SEQ ID NO: 14290 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQYGVYPFTFGQGTKLEIK

SEQ ID NO: 14291 - protein, 127 aa, Artificial Sequence
  Description of Artificial Sequence: Synthetic polypeptide
DIQMTQSPASLSASVGDTVTITCRASENIYSFLAWYHQKQGRSPQLLVYHAKTLAEGVPSRFSGSGSGTQFSLKINSLQAEDFGSYYCQHYYGSPLTFGAGTKLEVKRADAAPTVSIFPPSSEELSL

SEQ ID NO: 14292 - protein, 214 aa, Artificial Sequence
  Description of Artificial Sequence: Synthetic polypeptide
AIQLTQSPSSLSASVGDRVTITCRPSQGINWELAWYQQKPGKAPKLLIYDASSLEQGVPSRFSGSGSGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14293 - protein, 110 aa, Artificial Sequence
  Description of Artificial Sequence: Synthetic polypeptide
DIVLTQSPATLSLSPGERATLSCRASQFISSSYLSWYQQKPGQAPRLLIYGSSSRATGVPARFSGSGSGTDFTLTISSLEPEDFAVYYCQQLYSSPMTFGQGTKVEIKRT

SEQ ID NO: 14294 - protein, 215 aa, Artificial Sequence
  Description of Artificial Sequence: Synthetic polypeptide
DIVLTQSPATLSLSPGERATLSCRASQFISSSYLSWYQQKPGQAPRLLIYGSSSRATGVPARFSGSGSGTDFTLTISSLEPEDFAVYYCQQLYSSPMTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14295 - protein, 106 aa, Artificial Sequence
  Description of Artificial Sequence: Synthetic polypeptide
DIQMTQSPSSLSASVGDRVTITCSASSSVSYMHWYQQKPGKAPKLLIYSTSNLASGVPSRFSGSGSGTDFTLTISSLQPEDFATYYCQQRSSYPPTFGQGTKVEIK

SEQ ID NO: 14296 - protein, 128 aa, Mus musculus
MHFQVQIFSFLLISASVIMSRGQIVLIQSPVIMSASPGEKVTITCSASSSVSYMHWFQQKPGTSPKLWIYSTSNLASGVPARFSGSGSGTSYSLTISRMEAEDAATYYCQQRSSYPPTFGAGTKLELK

SEQ ID NO: 14297 - protein, 145 aa, Homo sapiens
GLFEAATMKLPVRLLVLWIRETNGDVVMTQTPLTLSVTIGQPASISCKSSQSLLDSDGKTYLNWLLQRPGQSPKRLIYLVSKLDSGVPDRFTGSGSGTDFTLKISRVEAEDLGVYYCWQGTHFPFTFGSGTKLEIKRTDAAPTVS

SEQ ID NO: 14298 - protein, 126 aa, Homo sapiens
GLFEAATMEAPAQLTLSVTIGQPASISCKSSQSLLDSDGKTYLNWLLQRPGQSPKRLIYLVSKLDSGVPDRFTGSGSGTDFTLKISRVEAEDLGVYYCWQGTHFPFTFGSGTKLEIKRTDAAPTVS

SEQ ID NO: 14299 - protein, 146 aa, Homo sapiens
MGFKMESQAQVLMLLLLWVSGTCGDIVMSQSPSSLAVSVGEKVTMSCKSSQSLLYRSNQKNYLAWYQQKPGQSPKLLIYWASTRESGVPDRFTGSGSGTDFTLTISSVKAEDLAVYYCQQYYNYPRTFGGGTKLEIKRTDAAPTVS

SEQ ID NO: 14300 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSYPLTFGGGTKVEIK

SEQ ID NO: 14301 - protein, 113 aa, Homo sapiens
DIVMTQSPDSLAVSLGERATIHCKSSQSILYSSNNKNYLAWYQQKPGQPPKLLLYWASTREAGVPDRFSGGGSGTDFTLTISSLQPEDSATYYCQQYNTYPLTFGGGTKVEIK

SEQ ID NO: 14302 - protein, 107 aa, Mus musculus; identical to SEQ ID NO: 12450
  MBL009-15 VL

SEQ ID NO: 14303 - protein, 107 aa, Mus musculus
  MBL016-8 VL
DIQMTQSPSSLSASLGGKVTITCKASQDINKYIAWYQHKPGKGPRLFIHYTSKLQPGIPSRFSGSGSGRDYSFSISNLEPEDIATYYCLQYDNLLYTFGGGTKLEIK

SEQ ID NO: 14304 - protein, 107 aa, Mus musculus
  MBL144-1 VL
DILMTQSPATLSVTPGETVSLSCRASQNTYKNLHWYQQKSHGTPKLLIKYASAPISGIPSRFTGSGSGTDYTLSINSVKPEDEGIYYCLQGYSMPWTFGGGTKLEIK

SEQ ID NO: 14305 - protein, 106 aa, Mus musculus
  MBL184-6 VL
IQMTQSSSSLSVSLGDRVTITCKASEHINSWLAWYQQKPGNAPRLLISGATNLKTGVPSRFSGSASGKDYTLNITSLQTEDVATYYCQQYWGTPWTFGGGTKLEIK

SEQ ID NO: 14306 - protein, 112 aa, Mus musculus
  MBL259-3 VL
DIVMTQAAPSVPVTPGESVSISCRSSKSLLHRNGNTYLYWFLQRPGQSPQLLIYRMSNLASGVPDRFSGSGSGTAFTLRISRVEAEDVGVYYCLQHLEYPYTFGSGTKLEIK

SEQ ID NO: 14307 - protein, 106 aa, Mus musculus
  MBL292-1 VL
IQMTQSSSSLSVSLGDRVTITCKASVHINSWLAWYQQKPGNAPRLLISGATNLKTGVPSRFSGSASGKDYTLSITSLQTEDVATYYCQQYWDTPWTFGGGTKLEIK

SEQ ID NO: 14308 - protein, 106 aa, Mus musculus
  MBL352-34 VL
IQMTQSSSSLSVSLGDRVTITCKASEHINSWLAWYQQKPGNAPRLLISGATNLKTGVPSRFSGSASGKDYTLSITSLQTEDVATYYCQQYWGTPWTFGGGTKLEIK

SEQ ID NO: 14309 - protein, 116 aa, Mus musculus
  MBL009-15VH
VQLQESGPGLVKPSQSLSLTCTVTGYSITSDYAWNWIRQFPGNKLEWMGYISYSGSTSYNPSLKSRISITRDTSKNQFFLQLNSVTTEDTATYYCARGGITRFAYWGQGTLVTVSA

SEQ ID NO: 14310 - protein, 91 aa, Mus musculus
  MBL016-8 VL
DIQMTQSPSSLSASLGGKVTITCKASQDINKYIAWYQHKPGKGPRLFIHYTSKLQPGIPSRFSGEDIATYYCLQYDNLLYTFGGGTKLEIK

SEQ ID NO: 14311 - protein, 111 aa, Mus musculus
  MBL016-8 VH
VQLQQSGAELVRPGASVKLSCTASGFNIKDDYMYWVKQRPEQGLEWIGRIDPANGNTKYAPKFQDKATITADTSSNTAYHLSSLTSEDTAVFYCAYRRAYWGQGTLVTVSA

SEQ ID NO: 14312 - protein, 106 aa, Mus musculus; identical to SEQ ID NO: 12452
  MBL018-1 VL

SEQ ID NO: 14313 - protein, 112 aa, Mus musculus
  MBL018-1 VH
EVQLQQSGTVLTRPGASVKMSCKASGYTFTNFWIHWVKQRPGQGLDWIGAIYPGNTNTDYNQKFQGKAKLTAVSSASTAYMELSSLTNEDSAVYYCTRGGAMDYWGQGTSVT

SEQ ID NO: 14314 - protein, 108 aa, Homo sapiens
SSELTQDPAVSVALGQTVRITCQGDSLRRYYASWYQQKPGQAPILVIYGKNNRPSGIPDRFSGSSSGNTASLTITGAQAEDEADYYCNSRDSSGNHLVFGGGTKLTVL

SEQ ID NO: 14315 - protein, 107 aa, Homo sapiens
DIQMTQSPSSLSASIGDRVTITCRASQGIRNDLGWYQQKPGKAPKRLIYAASSLQSGVPSRFSGSGSGPEFTLTISSLQPEDFATYYCLQHNSYPLTFGGGTKVEIK

SEQ ID NO: 14316 - protein, 107 aa, Homo sapiens
DIQMTQSPSSLSASVRDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 14317 - protein, 107 aa, Homo sapiens
DIQMTQSPSSLSASVGDRVTITCRASQGIRNDLTWYQQKPGKAPKRLIYAASSLQSGVPSRFSGSGSGTEFTLTISSLQPEDFATYYCLQHNSFPWTFGQGTKVEIK

SEQ ID NO: 14318 - protein, 114 aa, Homo sapiens
DVVMTQSPLSLPVTLGQPASISCRSSQSLVYSDGSTYLNWFQQRPGQSPRRLIYKVSNWDSGVPDRFSGSGSGTDFTLKISRVEAEDVGVYYCMQGSHWPREFTFGGGTKVEIK

SEQ ID NO: 14319 - protein, 107 aa, Homo sapiens
DIQMTQSPSSLSASVGDRVTITCRASQGIRNDLGWYQQKPGKAPKRLIYAASSLQSGVPSRFSGSGSGTEFTLTVSSLQPEDFATYYCLQHHSYPLTFGGGTKVQIN

SEQ ID NO: 14320 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNNYPLTFGGGTKVEIK

SEQ ID NO: 14321 - protein, 107 aa, Homo sapiens
DIQMTQSPSALSASVGDRVTITCRASQGIRNDLGWYQQKPGKAPKRLIYAASSLQSGVPSRFSGSGSGTEFTLTISSLQPEDFATYYCLQHKSYPLTFGGGTKVEIK

SEQ ID NO: 14322 - protein, 111 aa, Homo sapiens
DIVMTQSPLSLPVTPGEPASISCRSSQSLLHSNGYNYLDWYLQKPGQSPQLLIFLGSYRASGVPDRFSGSGSGTDFTLKISRVEAEDVGVYYCMQALQTWTFGQGTKVEIK

SEQ ID NO: 14323 - protein, 107 aa, Homo sapiens
DIQMTQSPSSLSASVGDRVTITCRASQGIRNDLGWYQQKPGKAPKRLISAASSLQGGVPSRFSGSGSGTEFTLTISSLQPEDFATYYCLQHNSYPLTFGGGTKVEIK

SEQ ID NO: 14324 - protein, 107 aa, Homo sapiens
DIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIK

SEQ ID NO: 14325 - protein, 106 aa, Homo sapiens
EIVMTQSPATLSVSPGERATLSCRASQSVTSNLAWYQQKPGQAPRLLIHGASIRATGLPARFSGSGSGTEFTLTISSLQSEDFAVYYCQQYNYWWTFGQGTKVEIK

SEQ ID NO: 14326 - protein, 106 aa, Homo sapiens
EIVMTQSPATLSVSPGERATLSCRASQSVSSNLAWYQQKPGQAPRLLIHGASIRATGLPARFSGSGSGTEFTLTISSLQSEDFAVYYCQQYNYWWTFGQGTKVEIK

SEQ ID NO: 14327 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIK

SEQ ID NO: 14328 - protein, 107 aa, Homo sapiens
DIQMTQSPSSLSASVGDRVTITCRASQGIRNDLGWYQQKPGKAPKRLIYAASSLHSGVPSRFSGSGSGTEFTLTISSLQPEDFATYYCLQHNSYPWTFGQGTKVEIK

SEQ ID NO: 14329 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHCCYPLTFGGGTKVEIK

SEQ ID NO: 14330 - protein, 107 aa, Homo sapiens
DIQMTQSPSSLSASVGDRVTITCRASQGIRIDLGWYQQKPGKAPKRLIYAASTLQSGVPSRFSGSGSGTEFIFTISSLQPEDFASYYCLQHKSYPLTFGGGTKVEIK

SEQ ID NO: 14331 - protein, 125 aa, Homo sapiens
QVQLVESGGGVVQPGRSLRLSCAASGFTFSNHDIHWVRQAPGKGLEWVAVIWSDGSNKYYADSVKGRFTISRDNSKNTLYLQMNSLRAEDTAVYYCAREKMATIKGYYYYGMDVWGQGTTVTVSS

SEQ ID NO: 14332 - protein, 112 aa, Oryctolagus cuniculus
QSLEESGGRLVTPGTPLTLTCTVSGIDLSSNTMGWFRRAPGKGLEWIGIIISSGTTYYASWVKGRFTISKTSTTVDLKITRPTTEDTATYFCARGWYEFNLWGPGTLVTVSS

SEQ ID NO: 14333 - protein, 118 aa, Homo sapiens
QVQLVESGGDVVQPGRSLRLSCAASGFTFSSSGMHWVRQAPGKGLEWVAIIWYDGSNKYYADSVKGRFTISRDNSKNTLYLQMNSLRAEDTAVYYCARDDYYYGMDVWGQGTTVTVSS

SEQ ID NO: 14334 - protein, 121 aa, Homo sapiens
QVQLVESGGGVVQPGRSLRLSCAASGFTFSSYGMHWVRQAPGKGLEWVAVIWYDGNNKYYADSVKGRFTISRDNSKNTLYLQMNSLRAEDTAVYYCARESDYGGNPYFDYWGQGTLVTVSS

SEQ ID NO: 14335 - protein, 121 aa, Homo sapiens
QVQLVESGGGVVQPGRSLRLSCAASGFTFSSYGMNWVRQAPGKGLEWVAVIWYDGSNKYYGDSVKGRFTISRDNSKNTLYVQMNSLRAEDTAVYYCARESDYGGNPYFDYWGQGTLVTVSS

SEQ ID NO: 14336 - protein, 116 aa, Homo sapiens
EVQLVQSGAEVKKPGESLKISCKGSGYSFTSDWIGWVRQMPGKGLEWMGIIYPGDSDTRYSPSFQGQVTISADKSITTAYLQWSSLKASDTAMYYCARSGYGMDVWGQGTTVTVSS

SEQ ID NO: 14337 - protein, 122 aa, Homo sapiens
QVQLVQSGAEVKKPGASVKVSCKASGYTFTSYGISWVRQAPGQGLEWMGWISAYNVNTNYAQKLQGRVTMTTDTSTNTAYMELRSLRSDDTAVYYCARDPITETMEDYFDYWGQGTLVTVSS

SEQ ID NO: 14338 - protein, 115 aa, Homo sapiens
EVQLVESGGGLIQPGGSLRLSCAASGFTVSSNYMSWVRQAPGKGLEWVSVIYSGGGTYYADSVKGRFTISRDNSKNTLYLQMNSLRAEDTAVYYCARGPGSFDYWGQGTLVTVSS

SEQ ID NO: 14339 - protein, 123 aa, Homo sapiens
QVQLVESGGGVVQPGRSLRLSCAASGFTFSSYGMHWVRQAPGKGLEWVAVIWYDGSIKYYADSVKGRFTISRDNSKNTLYLQMNSLRAEDTAVYYCARERDSSGWYYYGMDVWGQGTTVTVSS

SEQ ID NO: 14340 - protein, 126 aa, Homo sapiens
QVQLVESGGGVVQPGRSLRLSCAASGFTFSNYGMHWVRQAPGKGLEWVAVIWYDGSNKYYADSVKGRFTISRDNSKNTLYLQMNSLRAEDTAVYYCAREGIAVAGPPYYYYGMDVWGQGTTVTVSS

SEQ ID NO: 14341 - protein, 123 aa, Homo sapiens
QVQLVESGGGVVQPGRSLRLSCAASGLIFSSYGMHWVRQAPGKGLEWVAVIWYDGSNKYYADSVKGRFTISRDNSKNTLYLQMNSLRAEDTAVYYCARERDSSGWYYYGMDVWGQGTTVTVSS

SEQ ID NO: 14342 - protein, 115 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGEGGMDVWGQGTTVTVSS

SEQ ID NO: 14343 - protein, 116 aa, Homo sapiens
QVQLVESGGGLVKPGGSLRLSCAASGFTFSDYYMSWIRQAPGKGLEWVSYISRSGSTIYYADSVKGRFTISRDNAKNSLYLQMNSLRAEDTAVYYCARSLGGMDVWGQGTTVTVSS

SEQ ID NO: 14344 - protein, 115 aa, Homo sapiens
EVQLVESGGGLIQPGGSLRLSCAASGFTVSSNYVNWVRQAPGKGLEWVSVIYNAGSAYYADSVKGRFTISRDNSKNTLFLQMNSLRAEDTAVYYCARGTGAFDYWGQGTLVTVSS

SEQ ID NO: 14345 - protein, 107 aa, Homo sapiens
DIQMTQSPSSLSASVGDRVTITCRTSQSISSYLNWYQQKPGKAPEVLIYAASNLQRGVPSRFSGSGSGTDFTLTISSLQPEDFATYYCQQSSSTLITFGQGTRLEIK

SEQ ID NO: 14346 - protein, 107 aa, Homo sapiens
DIQMTQSPSSLSASVGDRVTITCRTSQSISSYLNWYQQKPGKAPELLIYAAFNLQSGVPSRISGSGSGTDFTLTISSLHPEDFATYYCQQSSSTLITFGQGTRLEIK

SEQ ID NO: 14347 - protein, 110 aa, Homo sapiens
QSVLTQPPSMSAAPGQKVTISCSGSSSNIGNNYVSWYQQLPGIAPKLLIYDNNKRPSGIPDRFSGSKSGTSATLGITGLQTGDEADYYCGTWDSSLSAGVFGGGTKLTVL

SEQ ID NO: 14348 - protein, 111 aa, Homo sapiens
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVL

SEQ ID NO: 14349 - protein, 107 aa, Homo sapiens
DIQMTQSPSSLSASVGDRVTITCRASQGIRNDLGWYQQKPRKAPKRLIFAASSLQSGVPSRFSGSGSGPEFTLTISSLQPEDFATYYCLQHNSYPLTFGGGTKVEIK

SEQ ID NO: 14350 - protein, 107 aa, Homo sapiens
EIVMTQSPATLSVSPGERVTLSCRASQSATSNLAWYQQKPGQAPRLLIYGASTRATGIPARFSGSGSGTEFTLTISSLQSEDFAVYYCQQYNNWPFTFGQGTRLEIK

SEQ ID NO: 14351 - protein, 109 aa, Homo sapiens
DIQMTQSPSSLSASVGDRVTITCRASQGIRNDLGWFQQKPGKAPKRLIYAASNFLSGVPSRFSGSGSGTEFTLTISSLQPEDFTTYYCLQHNPYPPRLTFGGGTKVEIK

SEQ ID NO: 14352 - protein, 108 aa, Homo sapiens
SSELTQDPAVSVALGQTVRITCQGDSLRSYYASWYQQKPGQAPVLVIYGKNNRPSGIPDRFSGSSSENTASLTITGAQAEDEADYYCKSRDSSFNHLVFGGGTKLTVL

SEQ ID NO: 14353 - protein, 108 aa, Homo sapiens
SSELTQDPAVSVALGQTVRITCQGDILRSYYASWYQQKPGQAPVLVIYGKNNRPSGIPDRFSGSSSGNTASLTITGAQAEDEADYYCKSRDSSYNHLVFGGGTKLTVL

SEQ ID NO: 14354 - protein, 111 aa, Homo sapiens
QSVLTQPPSVSGAPGLRVTISCTGNSSNIGAGYDVHWYQQLPGTAPKLLIYGNSNRPSGVPDRFSGSKSGTSASLAITGLQAEDETDYYCQSYDSSLSGSVFGGGTKLTVL

SEQ ID NO: 14355 - protein, 108 aa, Homo sapiens
SSELTQDPAVSVALGQTVRITCQGDILRSYYASWYQQKPGQAPILVIYGKNNRPSGIPDRFSGSSSGNTASLTITGAQAEDEADYYCKSRDSSYNHLVFGGGTKLTVL

SEQ ID NO: 14356 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 14357 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 14358 - protein, 107 aa, Homo sapiens
EIVMTQSPATLSVSPGERATLSCRASQSVISNLAWYQQQPGQAPRLLIYGASTRATGFPARFSGSGSGTEFTLTISSLQSEDFAVYYCQQYNNWPLTFGGGTKVEIK

SEQ ID NO: 14359 - protein, 107 aa, Homo sapiens
DIQMTQSPSSLSTSVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 14360 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHMSLPLTFGGGTKVEIK

SEQ ID NO: 14361 - protein, 107 aa, Homo sapiens
EIVMTQSPATLSVSPGERATLSCRASQSVTSNLAWYQQKPGQAPRLLIYGASTRATGIPARFSGSGSGTEFTLTISSLPSEDFAVYYCQQYHTWPFTFGPGTKVDIK

SEQ ID NO: 14362 - protein, 107 aa, Homo sapiens
EIVMTQSPSTLSVSPGERATLSCRASQSVTSNLAWYQQKPGQAPRLLIYGASTRATGIPARFSGSGSGTEFTLTISSLPSEDFAVYYCQQYHTWPFTFGPGTKVDIK

SEQ ID NO: 14363 - protein, 107 aa, Homo sapiens
DIQMTQSPSSLSASVGDRVTITCRASQGIRHDLGWYQQKPGKAPERLIYGASSLQSGVPSRFSGSGSGTEFTLTISSLQPEDFATYYCLQHNSYPLTFGGGTKVEIK

SEQ ID NO: 14364 - protein, 107 aa, Homo sapiens
DIQMTQSPSSLSASVGDRVTITCRASQGIRNDLGWYQQKPGKAPKCLIYVASSLQSGVPSRFSGSGSGTEFTLTISSLQPEDFATYYCLQHNSYPLTFGGGTKVEIK

SEQ ID NO: 14365 - protein, 107 aa, Homo sapiens
DIQMTQSPSSLSASVGDRVTITCRASQGIRNDLGWYQQKPGKAPKCLIYVASSLQSGVPSRFSGSGSGTEFTLTISSLQPEDFATYYCLQHNSYPWTFGQGTKVEIK

SEQ ID NO: 14366 - protein, 107 aa, Homo sapiens
DIQMTQSPSSLSASVGDRVTITCRASQGISNYLAWYQQKPGKVPKFLIYAASTLQSGVPSRFSGSGSGTDFTLTVSSLQPEDVATYYCQMYNSVPFTFGPGTKVDIK

SEQ ID NO: 14367 - protein, 111 aa, Artificial Sequence
  Description of Artificial Sequence: Synthetic polypeptide
  Synthetic polypeptide for light chain variable region of an anti-VEGF antibody
QSVLTQPPSASGTPGQRVTISCTGSSSNIGNNAVTWYQQLPGTAPKLLIYDDSHRPSGVPDRFSGSKSGTSASLAISGLRSEDEADYYCGTWDYSLSGYVFGGGTKLTVLG

SEQ ID NO: 14368 - protein, 111 aa, Artificial Sequence
  Description of Artificial Sequence: Synthetic polypeptide
  Synthetic polypeptide for light chain variable region of an anti-VEGF antibody
QSVLTQPPSASGTPGQRVTISCTGSSSNIGSNNVTWYQQLPGTAPKLLIYSDSHRPSGVPDRFSGSKSGTSASLAISGLQSEDEADYYCGSWDYSLSAYVFGGGTKLTVLG

SEQ ID NO: 14369 - protein, 111 aa, Artificial Sequence
  Description of Artificial Sequence: Synthetic polypeptide
  Synthetic polypeptide for light chain variable region of an anti-VEGF antibody
QSVLTQPPSASGTPGQRVTISCTGSSSNIGSNYVSWYQQLPGTAPKLLIYADSQRPSGVPDRFSGSKSGTSASLAISGLRSEDEADYYCGTWDYSLSGYVLGGGTKLTVLG

SEQ ID NO: 14370 - protein, 111 aa, Artificial Sequence
  Description of Artificial Sequence: Synthetic polypeptide
  Synthetic polypeptide for light chain variable region of an anti-VEGF antibody
QSVLTQPPSASGAPGQRVTISCSGSSSNIGSNDVSWYQQLPGTAPKLLIYADSNRPSGVPDRFSGSKSGTSASLAISGLRSEDEADYYCGSWDYSLSGYVFGGGTKLTVLG

SEQ ID NO: 14371 - protein, 111 aa, Artificial Sequence
  Description of Artificial Sequence: Synthetic polypeptide
  Synthetic polypeptide for light chain variable region of an anti-VEGF antibody
QSVLTQPPSSSGTPGQRVTISCTGSSSNIGSNAVTWYQQLPGTAPKLLIYDDNHRPSGVPDRFSGSKSGTSASLAISGLRSEDEADYYCGAWDYSLNAYVFGGGTKLTVLG

SEQ ID NO: 14372 - protein, 111 aa, Artificial Sequence
  Description of Artificial Sequence: Synthetic polypeptide
  Synthetic polypeptide for light chain variable region of an anti-VEGF antibody
QSVLTQPPSASGTPGQRVIISCSASSSNIGSNAVYWYQQLPGTAPKLLIYSDNQRPSGVPDRFSGSKSGTSASLAISGLRSEDEADYYCGSWDYSLSAYVFGGGTKLTVLG

SEQ ID NO: 14373 - protein, 111 aa, Artificial Sequence
  Description of Artificial Sequence: Synthetic polypeptide
  Synthetic polypeptide for light chain variable region of an anti-VEGF antibody
QSVLTQPPSLSGTPGQRVTISCTGSSSNIGSNSVSWYQQLPGTAPKLLIYDDNNRPSGVPDRFSGSKSGTSASLAISGLRSEDEADYYCGAWDYSLSAYVFGGGTKLTVLG

SEQ ID NO: 14374 - protein, 111 aa, Artificial Sequence
  Description of Artificial Sequence: Synthetic polypeptide
  Synthetic polypeptide for light chain variable region of an anti-VEGF antibody
QSVLTQPPSPSGTPGQRVTISCTGSSSNIGNYYVYWYQQLPGTAPKLLIYANSHRPSGVPDRFSGSKSGTSASLAISGLRSEDEADYYCGSWDDSLSAYVFGGGTKLTVLG

SEQ ID NO: 14375 - protein, 107 aa, Homo sapiens; identical to SEQ ID NO: 8206

SEQ ID NO: 14376 - protein, 107 aa, Mus musculus
DIVMTQSHKFMSTSVGDRVSFTCKASQDVFTAVAWYQQKPGQSPKLLIYWASTRRTGVPDRFTGSGSGTDYTLTISSVQAEDLALYYCQQHFSTPPTFGGGTKLEIK

SEQ ID NO: 14377 - protein, 108 aa, Homo sapiens
  2.7A4
SYELTQPPSVSVSPGQAARITCSGDALPQKYVFWYQQKSGQAPVLVIYEDSKRPSGIPERFSGSSSGTMATLTISGAQVEDEADYYCYSTDRSGNHRVFGGGTRLTVL

SEQ ID NO: 14378 - protein, 107 aa, Homo sapiens
  2.20A8
DIQMTQSPSSVSASVGDRVTITCRASQGIRSWLAWYQQKPGKAPKLLIYAISRLQSGVPSRFSGSGSGTDFTLTISSLQPEDFATYYCQQANSFPLTFGGGTKVEIK

SEQ ID NO: 14379 - protein, 107 aa, Homo sapiens
  3.15G8
DIQMTQSPSSVSASVGDRVTITCRASQGISSWLAWYQQKSGKAPKLLIYAASGLQSGVPSRFSGSGSGTDFTLTISSLQPEDLATYYCQQSHSLPPTFGQGTKVEIK

SEQ ID NO: 14380 - protein, 107 aa, Mus musculus
DIVLTQSPATLSVTPGDRVSLSCRASQRIYNYLHWYQQKSHESPRLLIKYASQSISGIPSRFSGSGSGTDFILTINSVETEDFGMYFCQQSNSWPLTFGAGTKLELR

SEQ ID NO: 14381 - protein, 106 aa, Mus musculus
QIVLTQSPAIMSASPGEKVTMTCSASSSVSYMHWYQQKSGTSPKRLIYDTSKLASGVPARFSGSGSGTSYSLTISSMEAEDAATYYCQQWNSNPPTFGAGTKLELK

SEQ ID NO: 14382 - protein, 107 aa, Artificial Sequence
  Description of Artificial Sequence: Synthetic polypeptide
  synthetic construct
DIQMTQSPSSLSASVGDRVTITCRASQDIGNYLAWYQQKPGKVPKLLIYYTSTLQSGVPSRFSGSGSGTDFTLTISSLQPEDVATYYCQHYNTVPPTFGGGTKVEIK

SEQ ID NO: 14383 - protein, 112 aa, Artificial Sequence
  Description of Artificial Sequence: Synthetic polypeptide
  synthetic construct
DIVMTQSPLSLPVTPGEPASISCRSSKSLLHSNGITYLDWYLQKPGQSPQLLIYQMSNLASGVPDRFSSSGSGTDFTLRISRVEAEDVGVYYCAQNLELPYTFGGGTKLEIK

SEQ ID NO: 14384 - protein, 616 aa, Artificial Sequence
  Description of Artificial Sequence: Synthetic polypeptide
  consensus sequence
LEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSQKTKIISNRGENSCKATGQVCHALCSPEGCWGPEPKDCVSCNVSRGRECVDKCNILEGEPREFVENSECIQCHPECLPQMNITCTGRGPDNCIQCAHYIDGPHCVKTCPAGVMGENNTLVWKYADAGHVCHLCHPNCTYGCTGPGLEGCNGPKIPS

SEQ ID NO: 14385 - protein, 133 aa, Mus musculus
MESQTQVLISLLFWVSGTCGDIVMTQSPSSLSVSAGEKVTMTCKSSQSLLNSGNQQNYLAWYQQKPGQPPKLLIYGASTRESGVPDRFTGSGSGTDFTLTINSVQAEDLAVYYCQSDHIYPYTFGGGTKLEIK

SEQ ID NO: 14386 - protein, 113 aa, Mus musculus
DIVMTQSPDSLAVSLGERATINCKSSQSLLNSGNQQNYLAWYQQKPGQPPKLLIYGASTRESGVPDRFSGSGSGTDFTLTISSLQAEDVAVYYCQSDHIYPYTFGQGTKLEIK

SEQ ID NO: 14387 - protein, 113 aa, Artificial Sequence
  Description of Artificial Sequence: Synthetic polypeptide
  Synthetic LV2 sequence
DIVMTQSPDSLAVSLGERVTINCKSSQSLLNSGNQQNYLAWYQQKPGQPPKLLIYGASTRESGVPDRFSGSGSGTDFTLTISSVQAEDVAVYYCQSDHIYPYTFGQGTKLEIK

SEQ ID NO: 14388 - protein, 113 aa, Artificial Sequence
  Description of Artificial Sequence: Synthetic polypeptide
  Synthetic LV4 sequence
DIVMTQSPDSLAVSAGERVTMNCKSSQSLLNSGNQQNYLAWYQQKPGQPPKLLIYGASTRESGVPDRFSGSGSGTDFTLTISSVQAEDVAVYYCQSDHIYPYTFGQGTKLEIK

SEQ ID NO: 14389 - protein, 108 aa, Artificial Sequence
  Description of Artificial Sequence: Synthetic polypeptide
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 14390 - protein, 237 aa, Artificial Sequence
  Description of Artificial Sequence: Synthetic polypeptide
  recombinant immunoglobulin
MKKNIAFLLASMFVFSIATNAYADIVMTQSQKFMSTSVGDRVSVTCKASQNVGTNVAWYQQKPGQSPKALIYSSSYRYSGVPDRFTGSGSGTDFTLTISHVQSEDLADYFCQQYNIYPLTFGPGTKLELRRAVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14391 - protein, 80 aa, Artificial Sequence
  Description of Artificial Sequence: Synthetic polypeptide
  Sequence is synthesized
DIQMTQSPSSLSASVGDRVTITCWYQQKPGKAPKLLIYGVPSRFSGSGSGTDFTLTISSLQPEDFATYYCFGQGTKVEIK

SEQ ID NO: 14392 - protein, 80 aa, Artificial Sequence
  Description of Artificial Sequence: Synthetic polypeptide
  Sequence is synthesized
DIVMTQSPLSLPVTPGEPASISCWYLQKPGQSPQLLIYGVPDRFSGSGSGTDFTLKISRVEAEDVGVYYCFGQGTKVEIK

SEQ ID NO: 14393 - protein, 80 aa, Artificial Sequence
  Description of Artificial Sequence: Synthetic polypeptide
  Sequence is synthesized
EIVLTQSPGTLSLSPGERATLSCWYQQKPGQAPRLLIYGIPDRFSGSGSGTDFTLTISRLEPEDFAVYYCFGQGTKVEIK

SEQ ID NO: 14394 - protein, 80 aa, Artificial Sequence
  Description of Artificial Sequence: Synthetic polypeptide
  Sequence is synthesized
DIVMTQSPDSLAVSLGERATINCWYQQKPGQPPKLLIYGVPDRFSGSGSGTDFTLTISSLQAEDVAVYYCFGQGTKVEIK

SEQ ID NO: 14395 - protein, 334 aa, Artificial Sequence
  Description of Artificial Sequence: Synthetic polypeptide
  synthetic construct
LADIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPDIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14396 - protein, 334 aa, Artificial Sequence
  Description of Artificial Sequence: Synthetic polypeptide
  synthetic construct
LADIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPDIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14397 - protein, 111 aa, Artificial Sequence
  Description of Artificial Sequence: Synthetic polypeptide
  Light chain variable region without signal sequence
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIK

SEQ ID NO: 14398 - protein, 113 aa, Artificial Sequence
  Description of Artificial Sequence: Synthetic polypeptide
  Variable domain
DIVMTQTPSSVTASAGEKVTINCKSSQSVLLSSNQKNYLAWYQQRLGQSPRLLIYWASTRESGVPDRFSGSGSTTDFTLTISSFQPEDAAVYYCQQGVSFPLTFGQGTKVELK

SEQ ID NO: 14399 - protein, 110 aa, Artificial Sequence
  Description of Artificial Sequence: Synthetic polypeptide
  Variable domain
QSALTQPPSVSGSPGKTVTISCTGTNSDVGYGNYVSWYQQLPGMAPKLLIYDVNRRASGIADRFSGSKSGNTASLTISGLQSEDEGDYHCASYRSANNAVFGGGTHLFVL

SEQ ID NO: 14400 - protein, 110 aa, Artificial Sequence
  Description of Artificial Sequence: Synthetic polypeptide
  Variable domain
QSALTQPPSVSGTLGKTVTISCAGTSSDIGNYNYVSWYQQLPGTAPKLLIYEVNKRPSGIPDRFSGSKSGNTASLSISGLQSEDEADYYCASYRSSNNVVFGGGTKLTVL

SEQ ID NO: 14401 - protein, 110 aa, Artificial Sequence
  Description of Artificial Sequence: Synthetic polypeptide
  Variable domain
QSVLTQPPSVSGTLGKTVTISCAGTSSDIGDYNYVSWYQQLPGTAPKLLIYDVNKRASGIPDRFSGSKSGNTASLSISGLQSEDEADYYCASYRSRNDYAFGGGTKLTVL

SEQ ID NO: 14402 - protein, 110 aa, Artificial Sequence
  Description of Artificial Sequence: Synthetic polypeptide
  Variable domain
QAVLTQPPSVSGTLGKTLTISCAGTSSDVGYGNYVSWYQQLPGTAPKLLIYAVSTRASGIPDRFSGSKSGNTASLTISGLQSEDEADYYCASYRSSNNYAFGAGTKLTVL

SEQ ID NO: 14403 - protein, 111 aa, Artificial Sequence
  Description of Artificial Sequence: Synthetic polypeptide
  Variable domain
QAGLTQLSSMSGSPGQTVTITCTGSSSNIGGGYYLSWYQHLPGTAPKLLIYSNINRASGVPDRFSGSTSGISASLTITGLQAEDEADYYCSSWDDSVSGPVFGGGTSLTVL

SEQ ID NO: 14404 - protein, 113 aa, Artificial Sequence
  Description of Artificial Sequence: Synthetic polypeptide
  Variable domain
DIVMTQTPTSVTASAGDKVTINCKSSQSVLFSSNQKNYLAWYQQRLGQSPRLLIYWASIRESGVPDRFSGSGSATDFTLTISNFQPEDAAVYYCQQGYSFPYSFGSGTRLEIR

SEQ ID NO: 14405 - protein, 106 aa, Mus musculus
QIVLIQSPVIMSASPGEKVTITCSASSSVSYMHWFQQKPGTSPKLWIYSTSNLASGVPARFSGSGSGTSYSLTISRMEAEDAATYYCQQRSSYPPTFGAGTKLELK

SEQ ID NO: 14406 - protein, 112 aa, Artificial Sequence
  Description of Artificial Sequence: Synthetic polypeptide
  humanized light chain variable region
DVLMTQTPLSLPVSLGDPASISCRSSQSIVHSNVNTYLEWYLQKPGQSPRLLIYKVSNRFSGVPDRFSGSGAGTDFTLRISRVEAEDLGIYYCFQGSHVPPTFGGGTKLEIK

SEQ ID NO: 14407 - protein, 109 aa, Artificial Sequence; identical to SEQ ID NO: 14285
  Description of Artificial Sequence: Synthetic polypeptide
  A12 immunoglobulin light chain variable region

SEQ ID NO: 14408 - protein, 107 aa, Artificial Sequence
  Description of Artificial Sequence: Synthetic polypeptide
  1A immunoglobulin light chain variable region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGPGTKVDIK

SEQ ID NO: 14409 - protein, 113 aa, Artificial Sequence
  Description of Artificial Sequence: Synthetic polypeptide
DIELTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPYTFGGGTKLEIKR

SEQ ID NO: 14410 - protein, 107 aa, Artificial Sequence [sequence omitted]

SEQ ID NO: 14411 - protein, 136 aa, Artificial Sequence
  Description of Artificial Sequence: Synthetic polypeptide
  immunoglobulin light chain variable region
ASVGDRVTFTCRASQDIRRDLGWYQQKPGKAPKRLIYAASRLQSGVPSRFSGSGSGTEFTLTISSLQPEDFATYYCLQHNNYPRTFGQGTEVEIIRTVAAPSVFIFPPSDEQLKSGTASVVCLLNNFYPREAKVQW

SEQ ID NO: 14412 - protein, 100 aa, Artificial Sequence
  Description of Artificial Sequence: Synthetic polypeptide
  synthetic construct
SSLSASVGDRVTFTCRASQDIRRDLGWYQQKPGKAPKRLIYAASRLQSGVPSRFSGSGSGTEFTLTISSLQPEDFATYYCLQHNNYPRTFGQGTEVEIIR

SEQ ID NO: 14413 - protein, 107 aa, Artificial Sequence
  Description of Artificial Sequence: Synthetic polypeptide
  immunoglobulin light chain variable region
DIQMTQSPSSLSASVGDRVTITCRASQGIRSDLGWFQQKPGKAPKRLIYAASKLHRGVPSRFSGSGSGTEFTLTISRLQPEDFATYYCLQHNSYPLTFGGGTKVEIK

SEQ ID NO: 14414 - protein, 92 aa, Artificial Sequence
  Description of Artificial Sequence: Synthetic polypeptide
  immunoglobulin light chain variable region
GDRVTITCRASQSISTFLNWYQQKPGKAPKLLIHVASSLQGGVPSRFSGSGSGTDFTLTISSLQPEDFATYYCQQSYNAPLTFGGGTKVEIK

SEQ ID NO: 14415 - protein, 91 aa, Artificial Sequence
  Description of Artificial Sequence: Synthetic polypeptide
  synthetic construct
RATLSCRASQSVRGRYLAWYQQKPGQAPRLLIYGASSRATGIPDRFSGSGSGTDFTLTISRLEPEDFAVFYCQQYGSSPRTFGQGTKVEIK

SEQ ID NO: 14416 - protein, 236 aa, Artificial Sequence
  Description of Artificial Sequence: Synthetic polypeptide
  light chain immunoglobulin
MDMRVPAQLLGLLLLWFPGARCDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14417 - protein, 236 aa, Artificial Sequence
  Description of Artificial Sequence: Synthetic polypeptide
  light chain immunoglobulin
MDMRVPAQLLGLLLLWFPGARCDIQMTQSPSSLSASVGDRVTFTCRASQDIRRDLGWYQQKPGKAPKRLIYAASRLQSGVPSRFSGSGSGTEFTLTISSLQPEDFATYYCLQHNNYPRTFGQGTEVEIIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14418 - protein, 236 aa, Artificial Sequence
  Description of Artificial Sequence: Synthetic polypeptide
  light chain immunoglobulin
MDMRVPAQLLGLLLLWFPGARCDIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14419 - protein, 236 aa, Artificial Sequence
  Description of Artificial Sequence: Synthetic polypeptide
  light chain immunoglobulin
MDMRVPAQLLGLLLLWFPGARCDIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14420 - protein, 108 aa, Artificial Sequence
  Description of Artificial Sequence: Synthetic polypeptide
  immunoglobulin light chain of 2.12.1 fx
DIQMTQSPSSLSASVGDRVTITCRASQDIRRDLGWYQQKPGKAPKRLIYAASRLQSGVPSRFSGSGSGTEFTLTISSLQPEDFATYYCLQHNNYPRTFGQGTKVEIKR

SEQ ID NO: 14421 - protein, 128 aa, Homo sapiens; identical to SEQ ID NO: 8051

SEQ ID NO: 14422 - protein, 128 aa, Homo sapiens; identical to SEQ ID NO: 8052

SEQ ID NO: 14423 - protein, 128 aa, Homo sapiens; identical to SEQ ID NO: 8053

SEQ ID NO: 14424 - protein, 128 aa, Homo sapiens; identical to SEQ ID NO: 8054

SEQ ID NO: 14425 - protein, 123 aa, Unknown
  Description of Unknown: rabbit polypeptide
MDMRAPTQLLGLLLLWLPGATFAQVLTQTPSSVSAAVGGTVTINCQSSQSVYSDWLSWYQQKGGQPPRQLIYEASKLASGVPSRFSGSGSGTQFTLTINDVQCDDAATYYCLASYDCTRADCL

SEQ ID NO: 14426 - protein, 123 aa, Unknown
  Description of Unknown: rabbit polypeptide
MDMRAPTQLLGLLLLWLPGATFAQVLTQTPSPVSAAVGSTVTIKCQSSPSVYSNYLSWYQQKSGQPPKQLIYDASHLASGVPSRFSGSGSGTQFTLTISGVQCDDAATYYCLGSYDCSSVDCH

SEQ ID NO: 14427 - protein, 234 aa, Homo sapiens
MVLQTQVFISLLLWISGAYGDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14428 - protein, 214 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSALLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14429 - protein, 214 aa, Artificial Sequence
  Description of Artificial Sequence: Synthetic polypeptide
DIQMTQSPSSLSASVGDRVTITCRASQDIRYYLNWYQQKPGKAPKLLIYVASSLQSGVPSRFSGSGSGTEFTLTVSSLQPEDFATYYCLQVYSTDNAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14430 - protein, 645 aa, Artificial Sequence
  Description of Artificial Sequence: Synthetic polypeptide
GACATCCAGATGACCCAGTCTCCATCTTCCCTGTCTGCATCTGTAGGGGACAGAGTCACCATCACTTGCAGGGCAAGTCAGGACATTAGGTATTATTTAAATTGGTATCAGCAGAAACCAGGAAAAGCTCCTAAGCTCCTGATCTATGTTGCATCCAGTTTGCAAAGTGGGGTCCCATCAAGGTTCAGCGGCAGTGGATCTGGGACAGAGTTCACTCTCACCGTCAGCAGCCTGCAGCCTGAAGATTTTGCGACTTATTACTGTCTACAGGTTTATAGTACCCCTCGGACGTTCGGCCAAGGGACCAAGGTGGAAATCAAACGTACGGTGGCTGCACCATCTGTCTTCATCTTCCCGCCATCTGATGAGCAGTTGAAATCTGGAACTGCCTCTGTTGTGTGCCTGCTGAATAACTTCTATCCCAGAGAGGCCAAAGTACAGTGGAAGGTGGATAACGCCCTCCAATCGGGTAACTCCCAGGAGAGTGTCACAGAGCAGGACAGCAAGGACAGCACCTACAGCCTCAGCAGCACCCTGACGCTGAGCAAAGCAGACTACGAGAAACACAAAGTCTACGCCTGCGAAGTCACCCATCAGGGCCTGAGCTCGCCCGTCACAAAGAGCTTCAACAGGGGAGAGTGTTGA

SEQ ID NO: 14431 - protein, 240 aa, Artificial Sequence
  Description of Artificial Sequence: Synthetic polypeptide
  Synthetic construct
MESQTQVLMSLLFWVSGTCGDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14432 - protein, 234 aa, Artificial Sequence
  Description of Artificial Sequence: Synthetic polypeptide
MMSSAQFLGLLLLCFQGTRCDIQMTQTTSSLSASLGDRVTISCRSSQDIRNYLNWYQQKPDGTVKLLIYYTSRSHSGVPSRFSGSGSGTDYSLTISNLEQEDIATYFCQQGNMFPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14433 - protein, 218 aa, Artificial Sequence
  Description of Artificial Sequence: Synthetic polypeptide
  Chimeric (anti-alpha2-VL-IGKC-CL) light chain
NIVLTQSPASLAVSLGQRATISCRASESVESYGNSFIYWYQQKPGQAPKLLIYLASNLASGVPARFSGSGSRTDFTLTIDPVEADDAATYYCQQNNEDPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 14434 - protein, 109 aa, Artificial Sequence
  Description of Artificial Sequence: Synthetic polypeptide
  Humanized Antibody Sequence
DIQMTQSPSSLSASVGDRVTITCRASQSISNYLAWYQQKPGKAPKLLIYAASSLESGVPSRFSGSGSGTDFTLTISSLQPEDFATYYCQQYNSLPWTFGQGTKVEIKRT

SEQ ID NO: 14435 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 14436 - protein, 106 aa, Homo sapiens; identical to SEQ ID NO: 3203

SEQ ID NO: 14437 - protein, 109 aa, Homo sapiens
TVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 14438 - protein, 115 aa, Artificial Sequence [sequence omitted]

SEQ ID NO: 14439 - protein, 115 aa, Artificial Sequence [sequence omitted]

SEQ ID NO: 14440 - protein, 117 aa, Artificial Sequence
  Description of Artificial Sequence: Synthetic polypeptide
  Recombinant Polypeptide
AVQLVESGGGLVQGGGSLRLACAASERIFDLNLMGWYRQGPGNERELVATCITVGDSTNYADSVKGRFTISMDYTKQTVYLHMNSLRPEDTGLYYCKIRRTWHSELWGQGTQVTVSS

SEQ ID NO: 14441 - protein, 125 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLCIDASDDITYYADSVKGRFTISRDNAKNTVYLQMNSLKPEDTGVYYCATPIGLSSSCLLEYDYDYWGQGTLVTVSS

SEQ ID NO: 14442 - protein, 130 aa, Artificial Sequence
  Description of Artificial Sequence: Synthetic polypeptide
  Nanobody sequence
EVQLVESGGGLVQAGGSLRLSCAASGRTISRYTMGWFRQAPGKEREFVAAISWSGDNTNYADSVKGRFTISRPNTKNTMYLQMNSLKPEDTAVYYCAADYRSGSYYQASEWTRPSGYDYWGQGTLVTVSS

SEQ ID NO: 14443 - protein, 125 aa, Artificial Sequence
  Description of Artificial Sequence: Synthetic polypeptide
  Nanobody sequence
EVQLVESGGGLVQPGGSLRLSCAASGFSLDYFAIGWFRQAPGKEREEISCISNSDGSTYYANSVKGRFTISIDNAKNTVYLQMTSLKPEDTAVYYCATPVGLGPFCKTTNDYDYSGQGTLVTVSS

SEQ ID NO: 14444 - protein, 124 aa, Artificial Sequence
  Description of Artificial Sequence: Synthetic polypeptide
  Nanobody sequence
EVQLVESGGGLVQPGGSLRLSCAASGFTLDYYAINWFRQAPGKEREGVSCISGGDGSTYYADSVKGRFTISRDNAKNTVYLQMNSLKPEDTAVYYCATALGLSSSCHGDGYDYWGQGTLVTVSS

SEQ ID NO: 14445 - protein, 125 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVSCIDASDDITYYADSVKGRFTISRDNAKNTVYLQMNSLKPEDTGVYYCATPIGLSSSCLLEYDYDYWGQGTLVTVSS

SEQ ID NO: 14446 - protein, 125 aa, Artificial Sequence
  Description of Artificial Sequence: Synthetic polypeptide
  Nanobody sequence
EVQLVESGGGLVQPGGSLRLSCAASGFILDYYAIGWFRQAPGKEREGVLSIDASDDITYYADSVKGRFTISRDNAKNTVYLQMNSLKPEDTGVYYCATPIGLSSSGLLEYDYDYWGQGTLVTVSS

SEQ ID NO: 14447 - protein, 125 aa, Artificial Sequence
  Description of Artificial Sequence: Synthetic polypeptide
  Nanobody sequence
EVQLVESGGGLVQPGGSLRLSAAASGFILDYYAIGWFRQAPGKEREGVLCIDASDDITYYADSVKGRFTISRDNAKNTVYLQMNSLKPEDTGVYYSATPIGLSSSCLLEYDYDYWGQGTLVTVSS

SEQ ID NO: 14448 - protein, 124 aa, Artificial Sequence
  Description of Artificial Sequence: Synthetic polypeptide
  Nanobody sequence
EVQLVESGGGLVQAGGSLRLSCAASGFTFDDYAIGWFRQAPGEEREGVSSISSTYGLTYYADSVKGRFTISSSNAKNTVYLQMNNLKPEDTAVYYCAATPIERLGLDAYEYDYWGQGTQVTVSS

SEQ ID NO: 14449 - protein, 124 aa, Artificial Sequence
  Description of Artificial Sequence: Synthetic polypeptide
  Recombinant Polypeptide
EVQLVESGGGLVQAGGSLRLSCAASGRTFSTYTMAWFRQAPGKEREFVQGISRSDGGTYDADSVKGRFTISRDNAKNTVYLQMNSLKPEDTAVYFCAAASVKLVYVNPNRYSYWGQGTQVTVSS

SEQ ID NO: 14450 - protein, 124 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14451 - protein, 124 aa, Artificial Sequence
  Description of Artificial Sequence: Synthetic polypeptide
  Recombinant Polypeptide
AVQLVESGGGSVQAGGSLRLTCAASGRTSRSYGMGWFRQAPGKEREFVSGISWRGDSTGYADSVKGRFTISRDNAKNTVDLQMNSLKPEDTAIYYCAAAAGSTWYGTLYEYDYWGQGTQVTVSS

SEQ ID NO: 14452 - protein, 130 aa, Artificial Sequence
  Description of Artificial Sequence: Synthetic polypeptide
  Recombinant Polypeptide
EVQLVESGGGLVQAGGSLRLSCAASGRTFSGFAMGWFRQAPGKEREFVAAISWSGGSLLYVDSVKGRFTISRDNAKNTVHLQMNSLKPGDTAVYYCAAMVGPPPRSLDYGLGNHYEYDYWGQGTQVTVSS

SEQ ID NO: 14453 - protein, 125 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14454 - protein, 126 aa, Artificial Sequence
  Description of Artificial Sequence: Synthetic polypeptide
  Recombinant Polypeptide
EVQLVESGGGLVQAGGSLRLSCAVSGRTFSGDVMGWFRQAPGKEREFVAGFSRSTSTTHYADSVKGRFTISGDNAKNTVYLQMNSLKPEDTAVYYCAANSRSSWVIFTIKGQYDRWGQGTQVTVSS

SEQ ID NO: 14455 - protein, 124 aa, Artificial Sequence
  Description of Artificial Sequence: Synthetic polypeptide
  Recombinant Polypeptide
EVQLVESGGGLVQAGGSLRVSCVASIRSFSSYVVGWFRQAPGKDREFVAGIAWGDGITYYADSVKGRFTISRDHAKNTAYLQMNSLRPEDTAVYYCAVRPGMIITTIQATYGFWGQGTQVTVSS

SEQ ID NO: 14456 - protein, 127 aa, Artificial Sequence
  Description of Artificial Sequence: Synthetic polypeptide
  Recombinant Polypeptide
EVQLVESGGGLVQAGASLRLSCAASGRYFSDYNMAWFRQAPGKEREFVAHISWLGGRTYYRDSVKGRFTISRDNAKDTVYLQMNSLKPEDTAVYSCAAGSPYGTELPYTRIEQYAYWGQGTQVTVSS

SEQ ID NO: 14457 - protein, 124 aa, Artificial Sequence
  Description of Artificial Sequence: Synthetic polypeptide
  Recombinant Polypeptide
AVQLVESGGGLVQAGGSLRLSCAASGRTFSTYTMAWFRQAPGKEREFVQGISRSDGGTYDADSVKGRFTISRDNAKNTVYLQMNSLKPEDTAVYFCAAANEYWVYVNPNRYTYWGRGTQVTVSS

SEQ ID NO: 14458 - protein, 126 aa, Artificial Sequence
  Description of Artificial Sequence: Synthetic polypeptide
  Recombinant Polypeptide
EVQLVESGGGLVQAGGSLRLSCTASGRTFENNAMAWFRQAAGKEREFVAGFSGSGGATYYAHSVEGRFTISRDNAKNTVDLQMNSLSLEDTAVYLCAARRKSGEVVFTIPARYDYWGQGTQVTVSS

SEQ ID NO: 14459 - protein, 131 aa, Artificial Sequence
  Description of Artificial Sequence: Synthetic polypeptide
  Recombinant Polypeptide
QVKLEESGGGLVQAGGSLRLSCAASGRAFSSYVMGWFRQAPGKEREIVGAISWRGGSTYYADSVKGRFTISRDNAKNTVYLQMNSLKPEDTAVYYCAAVYRVGAISEYSGTDYYTDEYDYWGQGTQVTVSS

SEQ ID NO: 14460 - protein, 127 aa, Artificial Sequence
  Description of Artificial Sequence: Synthetic polypeptide
  Recombinant Polypeptide
EVQLVESGGGLVQAGGSLRLSCAASGRTFSSYAMGWFRQAPGKEREFVVAINWSSGSTYYADSVKGRFTISRDNAKNTMYLQMNSLKPEDTAVYYCAAGYQINSGNYNFKDYEYDYWGQGTQVTVSS

SEQ ID NO: 14461 - protein, 129 aa, Artificial Sequence
  Description of Artificial Sequence: Synthetic polypeptide
  Recombinant Polypeptide
EVQLVESGGGLVQAGGSLRLSCAASGRTFSSYVMGWFRQATGKEREFVATIAWDSGSTYYADSVKGRFTISRDNAKNTVHLQMNSLKPEDTAVYYCAASYNVYYNNYYYPISRDEYDYWGQGTQVTVSS

SEQ ID NO: 14462 - protein, 122 aa, Artificial Sequence
  Description of Artificial Sequence: Synthetic polypeptide
  Recombinant Polypeptide
EVQLVESGGGLVQAGGSLRLSCAASGRGAWAWFRQAPGKEREFVGGLSWSADSTYYADSVKGRFTISRDNAKNTVFLQMTNLKADDTAVYYCAAHRRPFASVFTTTRMYDYWGPGTQVTVSS

SEQ ID NO: 14463 - protein, 243 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSAAAEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14464 - protein, 245 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14465 - protein, 249 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14466 - protein, 265 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGGSGGGGSGGGGSGGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14467 - protein, 242 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSAAAEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14468 - protein, 244 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14469 - protein, 248 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14470 - protein, 264 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGGSGGGGSGGGGSGGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14471 - protein, 249 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14472 - protein, 265 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14473 - protein, 248 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14474 - protein, 264 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14475 - protein, 257 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14476 - protein, 273 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSGGGGSGGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14477 - protein, 383 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14478 - protein, 377 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSAAAEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14479 - protein, 381 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14480 - protein, 381 aa, Artificial Sequence
  Description of Artificial Sequence: Synthetic polypeptide
  Recombinant Polypeptide
AVQLVESGGGSVQAGGSLRLTCAASGRTSRSYGMGWFRQAPGKEREFVSGISWRGDSTGYADSVKGRFTISRDNAKNTVDLQMNSLKPEDTAIYYCAAAAGSTWYGTLYEYDYWGQGTQVTVSSGGGGSGGGSEVQLVESGGGSVQAGGSLRLTCAASGRTSRSYGMGWFRQAPGKEREFVSGISWRGDSTGYADSVKGRFTISRDNAKNTVDLQMNSLKPEDTAIYYCAAAAGSTWYGTLYEYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14481 - protein, 371 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSAAAEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14482 - protein, 383 aa, Artificial Sequence
  Description of Artificial Sequence: Synthetic polypeptide
  Recombinant Polypeptide
EVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14483 - protein, 381 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSS

SEQ ID NO: 14484 - protein, 382 aa, Artificial Sequence
  Description of Artificial Sequence: Synthetic polypeptide
  Recombinant Polypeptide
AVQLVESGGGSVQAGGSLRLLTCAASGRTSRSYGMGWFRQAPGKEREFVSGISWRGDSTGYADSVKGRFTISRDNAKNTVDLQMNSLKPEDTAIYYCAAAAGSTWYGTLYEYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTQVTVSSGGGGSGGGSEVQLVESGGGSVQAGGSLRLTCAASGRTSRSYGMGWFRQAPGKEREFVSGISWRGDSTGYADSVKGRFTISRDNAKNTVDLQMNSLKPEDTAIYYCAAAAGSTWYGTLYEYDYWGQGTQVTVSS

SEQ ID NO: 14485 - protein, 383 aa, Artificial Sequence
  Description of Artificial Sequence: Synthetic polypeptide
  Recombinant Polypeptide
EVQLVRSGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSSGGGGSGGGSEVQLVESGGGLVQAGGSLRLSCAASDRTFSSNNMGWFRQAPGKEREFVAAIGWGGLETHYSDSVKGRFTISRDNAKNTVYLQMNSLKPEDTARYYCAVSSTRTVIYTLPRMYNYWGQGTQVTVSS

SEQ ID NO: 14486 - protein, 381 aa, Artificial Sequence
  Description of Artificial Sequence: Synthetic polypeptide
  Recombinant Polypeptide
EVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGSVQTGGSLRLTCAASGRTSRSYGMGWFRQAPGKEREFVSGISWRGDTSGYADSVKGRFTISRDNAKNTVDLQMNSLKPEDTAIYYCAAAAGSAWYGTLYEYDYWGQGTQVTVSS

SEQ ID NO: 14487 - protein, 257 aa, Artificial Sequence
  Description of Artificial Sequence: Synthetic polypeptide
  Recombinant Polypeptide
QVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSSGGGGSGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSS

SEQ ID NO: 14488 - protein, 273 aa, Artificial Sequence
  Description of Artificial Sequence: Synthetic polypeptide
  Recombinant Polypeptide
QVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSSGGGGSGGGGSGGGGSGGGGSGGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSS

SEQ ID NO: 14489 - protein, 257 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSS

SEQ ID NO: 14490 - protein, 257 aa, Artificial Sequence; identical to SEQ ID NO: 14489
  Description of Artificial Sequence: Synthetic polypeptide
  Recombinant Polypeptide

SEQ ID NO: 14491 - protein, 381 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 14492 - protein, 381 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSS

SEQ ID NO: 14493 - protein, 273 aa, Artificial Sequence
  Description of Artificial Sequence: Synthetic polypeptide
  Recombinant Polypeptide
QVKLEESGGGSVQTGGSLRLTCAASGRTSRSYGMGWFRQAPGKEREFVSGISWRGDSTGYADSVKGRFTISRDNAKNTVDLQMNSLKPEDTAIYYCAAAAGSAWYGTLYEYDYWGQGTQVTVSSGGGGSGGGGSGGGGSGGGGSGGGGSQVKLEESGGGLVQAGGSLRLSCVASGRTFSRTAMAWFRQAPGKEREFVATITWNSGTTRYADSVKGRFFISKDSAKNTIYLEMNSLEPEDTAVYYCAATAAAVITPTRGYYNYWGQGTQVTVSS

SEQ ID NO: 14494 - protein, 381 aa, Artificial Sequence; identical to SEQ ID NO: 14491
  Description of Artificial Sequence: Synthetic polypeptide
  Recombinant Polypeptide

SEQ ID NO: 14495 - protein, 381 aa, Artificial Sequence; identical to SEQ ID NO: 14492
  Description of Artificial Sequence: Synthetic polypeptide
  Recombinant Polypeptide
